United States Patent 12,508,308 (INFLUENZA mRNA VACCINES) - sequence listing, part 24

SEQ ID NO: 89760 - RNA, 1401 nt, Artificial Sequence
  derived and/or modified sequence opt1 from neuraminidase__InfluenzaB__ACF54162
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacaacuacaccgccaagcggcccuucgugaagcugaacgucgagaccgacaccgccgagauccgccugaugugcacggagaccuaccucgacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcauggagcuguacgugaaguacgacggcgaccccuggaccgacuccgaggcccuggcgcucagcggggucaugguguccauggaggagccgggcugguacagcuucggguucgagaucaaggacaagaagugcgacgugcccugcaucggcaucgagaugguccacgacgggggcaagaccacguggcacuccgccgccaccgccaucuacugccugaugggcagcgggcagcugcucugggacaccgugaccggcguggacauggcccuguga

SEQ ID NO: 89761 - RNA, 1401 nt, Artificial Sequence
  derived and/or modified sequence opt1 from neuraminidase__InfluenzaB__ACF54184
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgaaggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacaccgacacguaccacuccuacgccaacaacauccugcgcacccaggagagcgccugcaacugcaucggcgggaacugcuaccugaugaucaccgacggcagcgccuccggcaucagcgagugccgguuccucaagauccgcgaggggcggaucaucaaggagaucuuccccaccggccgcgugaagcacacggaggagugcacgugcggguucgccuccaacaagaccaucgagugcgcgugccgggacaacagcuacaccgccaagcgccccuucgugaagcugaacgucgagaccgacaccgccgagauccggcugaugugcaccgagaccuaccucgacacgccccgcccggacgacggcuccaucaccgggcccugcgagagcaacggcaacaagggcuccgggggcaucaagggcggguucgugcaccagcggauggccagcaagaucgggcgcugguacucccggaccaugagcaagaccaagcgcaugggcaugggccuguacgugaaguacgacggggaccccuggacggacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 89762 - RNA, 1401 nt, Artificial Sequence
  derived and/or modified sequence opt1 from neuraminidase__InfluenzaB__ACF54206
augcugcccagcaccauccagacccucacgcuguuccugaccuccggcggggugcuccugagccuguacgucuccgccagccucuccuaccugcuguacagcgacauccuccugaaguucuccaccaccgagacgaccgccccgaccaugccccuggacugcgcgaacgccagcaacgugcaggccgugaaccgcuccgccaccaagggcgucacgcuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacgcacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacacggacaccuaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccacgggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccugaugugcaccgagacguaccucgacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccugauggggagcggccagcugcucugggacacggugaccgggguggacauggcccuguga

SEQ ID NO: 89763 - RNA, 1401 nt, Artificial Sequence
  derived and/or modified sequence opt1 from neuraminidase__InfluenzaB__ACF54217
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 89764 - RNA, 1401 nt, Artificial Sequence; identical to SEQ ID NO: 89655
  derived and/or modified sequence opt1 from neuraminidase__InfluenzaB__ACF54228

SEQ ID NO: 89765 - RNA, 1401 nt, Artificial Sequence; identical to SEQ ID NO: 89676
  derived and/or modified sequence opt1 from neuraminidase__InfluenzaB__ACF54239

SEQ ID NO: 89766 - RNA, 1401 nt, Artificial Sequence
  derived and/or modified sequence opt1 from neuraminidase__InfluenzaB__ACF54261
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucgugagcgugaagcuggggaagaucccgacggucgagaacuccaucuuccacauggccgccuggagcggcuccgccugccacgacgggaaggaguggaccuacaucggcguggacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgucaagcugaacguggagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgucaaguacgacggggaccccuggaccgacuccgacgcccuggcgcucagcggcgugaugguguccauggaggagccggggugguacagcuucggcuucgagaucaaggacaagaagugcgacguccccugcaucgggaucgagauggugcacgacggcggcaaggagacguggcacuccgccgccaccgccaucuacugccugauggggagcggccagcugcucugggacaccgugaccggggucgacauggcccuguga

SEQ ID NO: 89767 - RNA, 1401 nt, Artificial Sequence
  derived and/or modified sequence opt1 from neuraminidase__InfluenzaB__ACF54272
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacaccgacacguaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcugaacgucgagaccgacaccgccgagauccgccugaugugcaccgagaccuaccucgacacgccccggccggacgacggcuccaucaccgggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggacggacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 89768 - RNA, 1401 nt, Artificial Sequence
  derived and/or modified sequence opt1 from neuraminidase__InfluenzaB__ACF54283
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcgaggaccggaacaagcugcgccaccucgugagcgugaagcuggggaagauccccaccgucgagaacuccaucuuccacauggccgccuggagcggcuccgccugccacgacgggaaggaguggaccuacaucggcguggacggcccggacagcaacgcccugcucaagaucaaguacggggaggcguacaccgacacguaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgucaagcugaacguggagaccgacaccgccgagauccgccugaugugcaccgagaccuaccucgacacgccccggccggacgacggcuccaucaccgggcccugcgagagcaacggcgacaagggcuccgggggcaucaagggcggguucgugcaccagcgcauggccagcaagaucgggcggugguacucccgcaccaugagcaagaccaagcggaugggcaugggccuguacgucaaguacgacggggaccccuggacggacuccgacgcccuggcgcucagcggcgugaugguguccauggaggagcccgggugguacagcuucggcuucgagaucaaggacaagaagugcgacgucccgugcaucgggaucgagauggugcacgacggcggcaaggagaccuggcacuccgccgccaccgccaucuacugccugauggggagcggccagcugcucugggacaccgugacgggggucgacauggcccuguga

SEQ ID NO: 89769 - RNA, 1401 nt, Artificial Sequence
  derived and/or modified sequence opt1 from neuraminidase__InfluenzaB__ACF54294
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaucccccuggacugcgcgaacgccagcaacgugcaggccgugaaccgcuccgccaccaagggcgucaccuuccuccugcccgagcccgaguggacguacccgcggcugagcugccccggguccaccuuccagaaggcccuccugaucagcccccaccgcuucggcgagaccaaggggaacuccgcgccccugaucauccgggagccguucaucgccugcggccccaaggagugcaagcacuucgcccucacccacuacgccgcgcagcccggcggguacuacaacggcacgcgcgaggaccggaacaagcugcgccaccugaucagcgugaagcucgggaagauccccaccguggagaacuccaucuuccacauggccgccuggagcggcuccgccugccacgacgggaaggaguggaccuacaucggcgucgacggcccggacagcaacgcccugcugaagaucaaguacggggaggcguacaccgacacguaccacuccuacgccaacaacauccuccggacccaggagagcgccugcaacugcaucggcgggaacugcuaccugaugaucaccgacggcagcgccuccggcaucagcgagugccgcuuccugaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcucaacgucgagaccgacaccgccgagauccgccugaugugcaccgagaccuaccuggacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccucuacgugaaguacgacggggaccccuggacggacuccgacgcccuggcgcugagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccucauggggagcggccagcugcugugggacaccgugacggggguggacauggcccucuga

SEQ ID NO: 89770 - RNA, 1401 nt, Artificial Sequence
  derived and/or modified sequence opt1 from neuraminidase__InfluenzaB__ACF54305
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucaccuuccuccugcccgagcccgaguggacguacccgcggcugagcugccccggguccaccuuccagaaggcccuccugaucagcccccaccgcuucggcgagaccaaggggaacuccgcgccccugaucauccgggagccguucaucgccugcggccccaaggagugcaagcacuucgcccucacccacuacgccgcgcagcccggcggguacuacaacggcacgcgcgaggaccggaacaagcugcgccaccugaucagcguggagcucgggaagauccccaccguggagaacuccaucuuccacauggccgccuggagcggcuccgccugccacgacgggaaggaguggaccuacaucggcgucgacggcccggacagcaacgcccugcugaagaucaaguacggggaggcguacaccgacacguaccacuccuacgccaacaacauccuccggacccaggagagcgccugcaacugcaucggcgggaacugcuaccugaugaucaccgacggcagcgccuccggcaucagcgagugccgcuuccugaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcucaacgucgagaccgacaccgccgagauccgccugaugugcaccgagaccuaccuggacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccucuacgugaaguacgacggggaccccuggacggacuccgacgcccuggcgcugagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccucauggggagcggccagcugcugugggacaccgugacggggguggacauggcccucuga

SEQ ID NO: 89771 - RNA, 1401 nt, Artificial Sequence
  derived and/or modified sequence opt1 from neuraminidase__InfluenzaB__ACF54316
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucaucggggugaugguguccauggaggagccgggcugguacagcuucggguucgagaucaaggacaagaacugcgacguccccugcaucggcaucgagauggugcacgacggcgggaaggagaccuggcacuccgccgccacggccaucuacugccugaugggcagcgggcagcugcucugggacaccgugaccggcgucaacauggcgcuguga

SEQ ID NO: 89772 - RNA, 1404 nt, Artificial Sequence
  derived and/or modified sequence opt1 from neuraminidase__InfluenzaB__ACF54338
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaacauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccucaugugcaccgagaccuaccuggacaccccgcggcccgacgacgggagcaucacgggccccugcgaguccaacggcgggaagggcagcgggggcaucaagggcggguucgugcaccagcgcauggccuccaagaucggccggugguacagccgcaccauguccaagaccgagcggaaggggaugggccuguacgugaaguacgacggggaccccugggccgacagcgacgcgcucgucuucuccggcgugauggugagcauggaggagccggggugguacuccuucggcuucgagaucaaggacaagaagugcgacguccccugcaucggcaucgagauggugcacgacgggggcaaggagaccuggcacagcgccgccacggccaucuacugccugaugggguccggccagcugcucugggacaccgugaccggcgucaacauggcccuguga

SEQ ID NO: 89773 - RNA, 1401 nt, Artificial Sequence
  derived and/or modified sequence opt1 from neuraminidase__InfluenzaB__ACF54349
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucaacccccaccgcuucggcgagaccaaggggaacagcgcgccccucaucauccgggagccguucaucgccugcggccccacggagugcaagcacuucgcccugacccacuacgccgcccagcccggcggguacuacaacggcacccgcgaggaccggaacaagcugcgccaccucaucuccgugaagcuggggaagauccccaccguggagaacagcaucuuccacauggccgccugguccggcagcgccugccacgacgggaaggaguggacguacaucggcgucgacggcccggacuccaacgcgcugcucaagaucaaguacggggaggccuacaccgacaccuaccacagcuacgccaagaacauccugcggacccaggaguccgccugcaacugcaucggcggggacugcuaccugaugaucacggacggcagcgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacacgccccggccgaacgacggcagcaucaccgggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcgcuggcccucuccggcgucauggugagcauggaggagcccgggugguacuccuucggcuucgagaucaaggacaagaagugcgacgugccgugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 89774 - RNA, 1401 nt, Artificial Sequence
  derived and/or modified sequence opt1 from neuraminidase__InfluenzaB__ACF54371
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaccggguccggccagcugcucugggacaccgugacggggguggacauggcgcuguga

SEQ ID NO: 89775 - RNA, 1401 nt, Artificial Sequence
  derived and/or modified sequence opt1 from neuraminidase__InfluenzaB__ACI22549
augcugcccagcaccauccagacccucacgcuguuccugaccuccggcggggugcuccugagccuguacgucuccgccagccucuccuaccugcuguacagcgacauccuccugaaguucuccccgaccgagaucaccgcccgcacgaugccccuggacugcgcgaacgccagcaacgugcaggccgugaaccgguccgccaccaagggcgucacccuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccacgguggaggacuccaucuuccacauggccgccuggagcggguccgccugccacgacggcaaggaguggaccuacaucggcgucgacgggccggacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgagaccuaccucgacacgccccgcccggacgacgggagcaucaccggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggcccucaucggggugaugguguccauggaggagcccggcugguacagcuucggguucgagaucaaggacaagaacugcgacgucccgugcaucggcaucgagauggugcacgacggcgggaaggagaccuggcacuccgccgccacggccaucuacugccugaugggcagcgggcagcugcucugggacaccgugaccggcgucaacauggcgcuguga

SEQ ID NO: 89776 - RNA, 1401 nt, Artificial Sequence
  derived and/or modified sequence opt1 from neuraminidase__InfluenzaB__ACI22551
augcugcccagcaccauccagacccucacgcuguuccugaccuccggcggggugcuccugagccuguacgucuccgccagccucuccuaccugcuguacagcgacauccuccugaaguucuccccgaccgagaucaccgcccugacgaugccccucgacugcgcgaacgccagcaacgugcaggccgugaaccgcuccgccaccaagggcgucacccugcugcuccccgagcccgaguggaccuacccgcggcugagcugccccggguccacguuccagaaggcccugcucaucagcccccaccgcuucggcgagaccaaggggaacuccgcgccccugaucauccgggagccguucaucgccugcggccccaacgagugcaagcacuucgcccugacccacuacgccgcgcagcccggcggguacuacaacggcacccgcggggaccggaacaagcuccgccaccugaucagcgugaagcugggcaagauccccacgguggagaacuccaucuuccacauggccgccuggagcggguccgccugccacgacggcaaggaguggaccuacaucggcgucgacgggccggacaacaacgcccuccugaagaucaaguacggcgaggcguacaccgacaccuaccacagcuacgccaacaacauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccucaugugcaccgagaccuaccuggacacgccccggccggacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcucgcccugaucggggugaugguguccauggaggagcccggcugguacagcuucggguucgagaucaaggacaagaacugcgacgucccgugcaucggcaucgagauggugcacgacggcgggaaggagaccuggcacuccgccgccacggccaucuacugccugaugggcagcgggcagcuccugugggacaccgugaccggcgucaacauggcgcuguga

SEQ ID NO: 89777 - RNA, 1401 nt, Artificial Sequence; identical to SEQ ID NO: 89776
  derived and/or modified sequence opt1 from neuraminidase__InfluenzaB__ACI22555

SEQ ID NO: 89778 - RNA, 1401 nt, Artificial Sequence; identical to SEQ ID NO: 89643
  derived and/or modified sequence opt1 from neuraminidase__InfluenzaB__ACI22557

SEQ ID NO: 89779 - RNA, 1401 nt, Artificial Sequence
  derived and/or modified sequence opt1 from neuraminidase__InfluenzaB__ACI22559
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccucuccgccaccaagggcgucacccugcugcuccccgagccggaguggaccuacccccgccugagcugccccggguccacguuccagaaggcccugcucaucagcccccaccgguucggcgagaccaaggggaacuccgcgccgcugaucauccgcgagcccuucaucgccugcggccccaaggagugcaagcacuucgcccugacccacuacgccgcgcagcccggcggguacuacaacggcacccgcggggaccggaacaagcuccggcaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaacauccugcgcacgcaggaguccgccugcaacugcaucgggggcaacugcuaccucaugaucaccgacggcagcgccagcgggguguccgagugccgguuccugaagauccgcgagggccggaucaucaaggagaucuuccccaccgggcgcaucaagcacaccgaggagugcacgugcggcuucgccagcaacaagaccaucgagugcgcgugccgggacaacuccuacaccgccaagcgccccuucgugaagcugaacgucgagaccgacacggccgagauccggcucaugugcaccgagaccuaccuggacaccccgcgccccgacgacgggagcaucacgggccccugcgaguccaacggcgggaagggcagcgggggcaucaagggcggguucgugcaccagcggauggccuccaagaucggccgcugguacagccggaccauguccaagaccgagcgcaaggggaugggccuguacgugaaguacgacggggaccccugggccgacagcgacgcgcucgccuucuccggcgucauggugagcauggaggagccggggugguacuccuucggcuucgagaucaaggacaagaagugcgacgugcccugcaucggcaucgagaugguccacgacgggggcaaggagaccuggcacagcgccgccacggccaucuacugccugaugggguccggccagcugcucugggacaccgugaccggcgugaacauggcgcuguga

SEQ ID NO: 89780 - RNA, 1401 nt, Artificial Sequence
  derived and/or modified sequence opt1 from neuraminidase__InfluenzaB__ACI22561
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgggacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgucaagcuggggaagaucccgacgguggagaacuccaucuuccacauggccgccuggagcggcuccgccugccacgacggcaaggaguggaccuacaucgggguggacggccccgacaacaacgcccugcucaagaucaaguacggggaggcguacaccgacaccuaccacagcuacgccaacaagauccugcggacgcaggaguccgccugcaacugcaucggcggcaacugcuaccugaugaucaccgacgggagcgccagcggcgucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacggcagcaucacgggccccugcgaguccaacggggacaagggcagcgggggcaucaagggcggguucgugcaccagcgcauggccuccaagaucggccggugguacagccgcaccauguccaagaccgagcggauggggaugggccuguacgugaaguacgacggggaccccugggccgacagcgacgcgcuggccuucuccggcgucauggugagcaugaaggagccggggugguacuccuucggcuucgagaucaaggacaagaagugcgacgugcccugcaucggcaucgagaugguccacgacgggggcaaggagaccuggcacagcgccgccacggccaucuacugccucaugggguccggccagcugcugugggacaccgugaccggcguggacauggcgcucuga

SEQ ID NO: 89781 - RNA, 1401 nt, Artificial Sequence; identical to SEQ ID NO: 89643
  derived and/or modified sequence opt1 from neuraminidase__InfluenzaB__ACI22563

SEQ ID NO: 89782 - RNA, 1401 nt, Artificial Sequence
  derived and/or modified sequence opt1 from neuraminidase__InfluenzaB__ACI22565
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcaucaagcacaccgaggagugcacgugcggcuucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccgacgacgggagcaucacgggccccugcgaguccaacggcgggaagggcagcgggggcaucaagggcggguucgugcaccagcggauggccuccaagaucggccgcugguacagccggaccauguccaagaucgagcgcaaggggaugggccuguacgugaaguacgacggggaccccugggccgacagcgacgcgcuggccuucuccggcgucauggugagcauggaggagccggggugguacuccuucggcuucgagauccgggacaagaagugcgacgugcccugcaucggcaucgagaugguccacgacgggggcaaggagaccuggcacagcgccgccaccgccaucuacugccucaugggguccggccagcugcugugggacacggugaccggcgugaacauggcgcucuga

SEQ ID NO: 89783 - RNA, 1401 nt, Artificial Sequence; identical to SEQ ID NO: 89643
  derived and/or modified sequence opt1 from neuraminidase__InfluenzaB__ACI22567

SEQ ID NO: 89784 - RNA, 1401 nt, Artificial Sequence; identical to SEQ ID NO: 89643
  derived and/or modified sequence opt1 from neuraminidase__InfluenzaB__ACI22569

SEQ ID NO: 89785 - RNA, 1401 nt, Artificial Sequence
  derived and/or modified sequence opt1 from neuraminidase__InfluenzaB__ACJ53908
augcugcacagcaccauccagacccucacgcuguuccugaccuccggcggggugcuccugagccuguacgucuccgccagccucuccuaccugcuguacagcgacauccuccugaaguucucccagaccgagaucaccgcccccaucaugccgcuggacugcgcgaacgccagcuccgugcaggccgugaaccgcagcgccgccaagggcgucacgcuccugcugcccgagcccgaguggaccuacccccggcucuccugcccggggagcaccuuccagaaggcgcugcugaucagcccccaccgcuucggcgagaccaaggggaacuccgcgccccucaucauccgggagcccuucaucgccugcggcccgacggagugcaagcacuucgcccugacccacuacgccgcccagcccggcggguacuacaacggcacccgcgaggaccggaacaagcugcgccaccucaucuccgugaagcuggggaagauccccaccguggagaacagcaucuuccacauggccgccugguccggcagcgccugccacgacgggaaggaguggacguacaucggcgucgacggccccgacuccaacgcgcugcucaagaucaaguacggggaggccuacaccgacaccuaccacagcuacgccaagaacauccugcggacccaggagagcgccugcaacugcaucggcggggacugcuaccugaugaucacggacggcccggccuccggcaucagcgagugccgcuuccucaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacaccgccgagauccgccugaugugcacggagaccuaccucgacacgccccggccgaacgacggcuccaucaccgggcccugcgagagcgacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcgcuggcccucagcggcgucaugguguccauggaggagcccgggugguacagcuucggcuucgagaucaaggacaagaagugcgacgugccgugcaucgggaucgagaugguccacgacggcggcaagaccacguggcacuccgccgccaccgccaucuacugccugauggggagcggccagcugcucugggacaccgugaccgggguggacauggcgcuguga

SEQ ID NO: 89786 - RNA, 1401 nt, Artificial Sequence; identical to SEQ ID NO: 89661
  derived and/or modified sequence opt1 from neuraminidase__InfluenzaB__ACN32560

SEQ ID NO: 89787 - RNA, 1401 nt, Artificial Sequence; identical to SEQ ID NO: 89731
  derived and/or modified sequence opt1 from neuraminidase__InfluenzaB__ACN32582

SEQ ID NO: 89788 - RNA, 1401 nt, Artificial Sequence; identical to SEQ ID NO: 89643
  derived and/or modified sequence opt1 from neuraminidase__InfluenzaB__ACN32593

SEQ ID NO: 89789 - RNA, 1401 nt, Artificial Sequence
  derived and/or modified sequence opt1 from neuraminidase__InfluenzaB__ACN32604
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguucaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 89790 - RNA, 1401 nt, Artificial Sequence; identical to SEQ ID NO: 89643
  derived and/or modified sequence opt1 from neuraminidase__InfluenzaB__ACN32615

SEQ ID NO: 89791 - RNA, 1401 nt, Artificial Sequence
  derived and/or modified sequence opt1 from neuraminidase__InfluenzaB__ACN32775
augcugcccagcaccauccagacccucacgcuguuccugaccuccggcggggugcuccugagccuguacgucuccgccagccucuccuaccugcuguacagcgacauccuccugaaguucuccccgaccgagaucaacgcccccaccaugccccuggacugcgcgaacgccagcaacgugcacgccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaaguccaucgagugcgcgugccgcgacaacagcuacaccgccaagcggcccuucgugaagcugaacgucgagaccgacaccgccgagauccgccugaugugcaccgacacguaccucgacaccccgcggcccgacgacggguccaucaccggccccugcgagagcaacggcgacaagggguccggcgggaucaagggcggguucgugcaccagcgcauggccagcaagaucggccggugguacucccgcaccaugagcaagacggagcggaugggcauggggcuguacgugaaguacgacggcgaccccugggccgacuccgacgcgcuggccuucagcggggucaugguguccaugaaggagccgggcugguacagcuucggguucgagaucaaggacaagaagugcgacgugcccugcaucggcaucgagaugguccacgacggcgggaaggagaccuggcacuccgccgccaccgccaucuacugccucaugggcagcgggcagcugcugugggacaccgugacgggcguggacauggcgcucuga

SEQ ID NO: 89792 - RNA, 1401 nt, Artificial Sequence; identical to SEQ ID NO: 89643
  derived and/or modified sequence opt1 from neuraminidase__InfluenzaB__ACN32786

SEQ ID NO: 89793 - RNA, 1401 nt, Artificial Sequence
  derived and/or modified sequence opt1 from neuraminidase__InfluenzaB__ACO05928
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggccuucuccggggucauggugccgauggaggagcccggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcgugaacauggcgcucuga

SEQ ID NO: 89794 - RNA, 1401 nt, Artificial Sequence; identical to SEQ ID NO: 89655
  derived and/or modified sequence opt1 from neuraminidase__InfluenzaB__ACO05950

SEQ ID NO: 89795 - RNA, 1401 nt, Artificial Sequence
  derived and/or modified sequence opt1 from neuraminidase__InfluenzaB__ACO05961
augcugcccagcaccauccagacccucacgcuguuccugaccuccggcggggugcuccugagccuguacgucuccgccagccucuccuaccugccguacagcgacauccugcucaaguuccccuccaccgagaucaccgcccccacgaugccccuggacugcgcgaacgccagcaacgugcaggccgugaaccgcuccgccaccaagggcgucacccugcuccugccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaaggagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggccguucgugaagcucaacgucgagaccgacacggccgagauccgccugaugugcaccgagaccuaccuggacacgccccggcccgacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgacccgugggccgacagcgacgcgcuggccuucuccggggucauggugagcauggaggagcccggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcuccugugggacaccgugaccggcgugaacauggcgcuguga

SEQ ID NO: 89796 - RNA, 1401 nt, Artificial Sequence
  derived and/or modified sequence opt1 from neuraminidase__InfluenzaB__ACO05972
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 89797 - RNA, 1401 nt, Artificial Sequence; identical to SEQ ID NO: 89796
  derived and/or modified sequence opt1 from neuraminidase__InfluenzaB__ACO05983

SEQ ID NO: 89798 - RNA, 1401 nt, Artificial Sequence; identical to SEQ ID NO: 89796
  derived and/or modified sequence opt1 from neuraminidase__InfluenzaB__ACO05994

SEQ ID NO: 89799 - RNA, 1401 nt, Artificial Sequence
  derived and/or modified sequence opt1 from neuraminidase__InfluenzaB__ACO06005
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgaccgcgggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89800 - RNA, 1401 nt, Artificial Sequence
  derived and/or modified sequence opt1 from neuraminidase__InfluenzaB__ACO06027
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacaugacgcuguga

SEQ ID NO: 89801 - RNA, 1401 nt, Artificial Sequence
  derived and/or modified sequence opt1 from neuraminidase__InfluenzaB__ACO06066
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgucgccaagggcgugacgcuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccgucgagaacuccaucuuccacauggccgccuggagcggcuccgccugccacgacgggaaggaguggacguacaucggcguggacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcccuggcgcucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacaugacgcuguga

SEQ ID NO: 89802 - RNA, 1401 nt, Artificial Sequence
  derived and/or modified sequence opt1 from neuraminidase__InfluenzaB__ACO94665
augcugcccagcaccauccagacccucacgcuguuccugaccuccggcggggugcuccugagccuguacgucuccgccagccucuccuaccugcuguacagcgacauccuccugaaguucuccccgaccgagaucaccgccagcacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 89803 - RNA, 1401 nt, Artificial Sequence; identical to SEQ ID NO: 89643
  derived and/or modified sequence opt1 from neuraminidase__InfluenzaB__ACQ45607

SEQ ID NO: 89804 - RNA, 1401 nt, Artificial Sequence
  derived and/or modified sequence opt1 from neuraminidase__InfluenzaB__ACQ45610
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacggugccccuggacugcgcgaacgccagcaacgugcaggccgucaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaaguacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89805 - RNA, 1401 nt, Artificial Sequence; identical to SEQ ID NO: 89643
  derived and/or modified sequence opt1 from neuraminidase__InfluenzaB__ACQ45613

SEQ ID NO: 89806 - RNA, 1401 nt, Artificial Sequence; identical to SEQ ID NO: 89799
  derived and/or modified sequence opt1 from neuraminidase__InfluenzaB__ACR15626

SEQ ID NO: 89807 - RNA, 1401 nt, Artificial Sequence; identical to SEQ ID NO: 89799
  derived and/or modified sequence opt1 from neuraminidase__InfluenzaB__ACR15637

SEQ ID NO: 89808 - RNA, 1401 nt, Artificial Sequence; identical to SEQ ID NO: 89770
  derived and/or modified sequence opt1 from neuraminidase__InfluenzaB__ACR15648

SEQ ID NO: 89809 - RNA, 1401 nt, Artificial Sequence; identical to SEQ ID NO: 89799
  derived and/or modified sequence opt1 from neuraminidase__InfluenzaB__ACR15659

SEQ ID NO: 89810 - RNA, 1401 nt, Artificial Sequence; identical to SEQ ID NO: 89799
  derived and/or modified sequence opt1 from neuraminidase__InfluenzaB__ACR15670

SEQ ID NO: 89811 - RNA, 1401 nt, Artificial Sequence; identical to SEQ ID NO: 89624
  derived and/or modified sequence opt1 from neuraminidase__InfluenzaB__ACR15681

SEQ ID NO: 89812 - RNA, 1401 nt, Artificial Sequence
  derived and/or modified sequence opt1 from neuraminidase__InfluenzaB__ACR15692
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugggcugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaaggagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaagaucaaguacggggaggcguacaccgacaccuaccacagcuacgccaacaacauccugcggacgcaggaguccgccugcaacugcaucggcggcaacugcuaccugaugaucaccgacgggagcgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacggcagcaucacgggccccugcgaguccaacggggacaagggcagcgggggcaucaagggcggguucgugcaccagcgcauggccuccaagaucggccggugguacagccgcaccauguccaagaccaagcggauggggaugggccuguacgugaaguacgacggggaccccugggccgacaacgacgcgcuggcccucagcggcgucaugguguccauggaggagccggggugguacagcuucggcuucgagaucaaggacaagaagugcgacgugcccugcaucggcaucgagaugguccacgacgggggcaaggagaccuggcacuccgccgccacggccaucuacugccugauggggagcggccagcugcucugggacaccgugaccggcguggacauggcgcuguga

SEQ ID NO: 89813 - RNA, 1401 nt, Artificial Sequence; identical to SEQ ID NO: 89800
  derived and/or modified sequence opt1 from neuraminidase__InfluenzaB__ACR15703

SEQ ID NO: 89814 - RNA, 1401 nt, Artificial Sequence; identical to SEQ ID NO: 89800
  derived and/or modified sequence opt1 from neuraminidase__InfluenzaB__ACR15714

SEQ ID NO: 89815 - RNA, 1401 nt, Artificial Sequence; identical to SEQ ID NO: 89715
  derived and/or modified sequence opt1 from neuraminidase__InfluenzaB__ACR15725

SEQ ID NO: 89816 - RNA, 1401 nt, Artificial Sequence; identical to SEQ ID NO: 89676
  derived and/or modified sequence opt1 from neuraminidase__InfluenzaB__ACR15736

SEQ ID NO: 89817 - RNA, 1401 nt, Artificial Sequence; identical to SEQ ID NO: 89799
  derived and/or modified sequence opt1 from neuraminidase__InfluenzaB__ACR39340

SEQ ID NO: 89818 - RNA, 1401 nt, Artificial Sequence
  derived and/or modified sequence opt1 from neuraminidase__InfluenzaB__ADL28399
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaucaucgagugcgcgugccgcgacuccagcuacaccgccaagcggcccuucgucaagcugaacguggagaccgacaccgccgagauccgccugaugugcacggagaccuaccucgacaccccgcggcccaacgacggguccaucaccggccccugcgagagcaacggcgacaagggguccggcgggaucaagggcggguucgugcaccagcgcauggccagcaagaucggccggugguacucccgcacgaugagcaagaccgagcggaugggcauggggcuguacgucaaguacgacggcgaccccugggccgacuccgacgcgcuggcccucagcggggugaugguguccauggaggagccgggcugguacagcuucggguucgagaucaaggacaagaagugcgacguccccugcaucggcaucgagauggugcacgacggcgggaaggagaccuggcacuccgccgccaccgccaucuacugccugaugggcagcgggcagcugcucugggacacggugaccggcgucgacauggcgcuguga

SEQ ID NO: 89819 - RNA, 1401 nt, Artificial Sequence; identical to SEQ ID NO: 89796
  derived and/or modified sequence opt1 from neuraminidase__InfluenzaB__ADN32822

SEQ ID NO: 89820 - RNA, 1401 nt, Artificial Sequence
  derived and/or modified sequence opt1 from neuraminidase__InfluenzaB__ADR02756
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaucccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 89821 - RNA, 1401 nt, Artificial Sequence
  derived and/or modified sequence opt1 from neuraminidase__InfluenzaB__AEA51353
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacgggggcgcguucaccgacaccuaccacuccuacgccaagaacauccugagcccccaggagagcgccugcaacugcaucgggggcgacugcuaccugaugaucaccgacggccccgccuccgggaucagcgagugccgguuccucaagauccgcgagggccggaucaucaaggagaucuuccccacggggcgcgugaagcacaccgaggagugcacgugcggcuucgccuccaacaagaccaucgagugcgcgugccgggacaacagcuacaccgccaagcgcccguucgugaagcugaacgucgagaccgacaccgccgagauccggcugaugugcaccgagacguaccucgacacgccccgccccaacgacggguccaucaccggccccugcgagagcaacggcgacaagggguccggcgggaucaagggcggguucgugcaccagcggauggccagcaagaucggccgcugguacucccggaccaugagcaagaccaagcgcaugggcauggggcuguacgugaaguacgacggcgacccguggaccgacuccgaggcccuggcgcucagcggggucaugguguccauggaggagcccggcugguacagcuucggguucgagaucaaggacaagaagugcgacgugcccugcaucggcaucgagaugguccacgacggcgggaagaccaccuggcacuccgccgccacggccaucuacugccugaugggcagcgggcagcugcucugggacaccgugaccggcgugaacaugacccuguga

SEQ ID NO: 89822 - RNA, 1401 nt, Artificial Sequence
  derived and/or modified sequence opt1 from neuraminidase__InfluenzaB__AEA51355
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacaccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaccuacggcgaggccuaccccgggacguaccacagcuacgcgaucaagaacccccggacccaggaguccgccccgaacugcuucggcggccacagcuuccccaucaucacccacgccccgcccagcggggugugggagccccgcuuccugaagauccgggagggccgcaucaucaacgagaucuuccccaccgggcgggugaagccgcccgaggagugcacgugcggcuucgccuccaacaacaccaucgagugcgccugccgcgacaacaacugcaccgcgaagcggcccuucgucaaguuccacguggagagcgaccccgccgagauccgcgccaugugcaccgacacguaccuggacagcccccggcccgacgacggguccaucaccggcccgugcgacuccaacggcgacaaggggagcggcgggaucaagggcggguucgugcaccagcgcauggaguccaagaucggccggugguacagccgcaccauguccaagaccgagcggaugggcauggggcucuacgucaaguacgacggcgaccccugggccgacagcgacgcccuggcgaacuccggggugauggugagcaugaacgagcccggcuccagcuccuucggguucgagaucaaggacaagaagugcgacgucccgugcaucggcaucgagauggugcacgacggcgggaaggagacguggcacagcgccgccaccgccaucuacugccugaugggcuccgggcagcuccugugggacaccgugaccggcgucgacauggcccuguga

SEQ ID NO: 89823 - RNA, 1401 nt, Artificial Sequence
  derived and/or modified sequence opt1 from neuraminidase__InfluenzaB__AEA51357
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguucggggaggcguacaccgacaccuaccacuccuacgccaagaacauccugggcacccaggagagcgccugcaacugcaucgggggcgacugcaaccugaugaucacggacggccccgccagcgggaucuccgagagccgguuccucaagaucggcgaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccaacgacggcuccaucaccggccccugcgagagcaacggggacaagggcuccgggggcaucaagggcggguucgugcaccagcgcauggccagcaagaucggccggugguacucccgcacgaugagcaagaccgagcggauggggaugggccuguacgugaaguacgacggggaccccugggccgacuccgacgcgcuggccuucagcggcgucaugguguccaugaaggagccggggugguacagcuucggcuucgagaucaaggacaagaagugcgacgugcccugcaucggcaucgagaugguccacgacgggggcaaggagaccuggcacuccgccgccaccgccaucuacugccucauggggagcggccagcugcugugggacacggugaccggcgugaacauggcgcucuga

SEQ ID NO: 89824 - RNA, 1401 nt, Artificial Sequence
  derived and/or modified sequence opt1 from neuraminidase__InfluenzaB__AEA51359
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 89825 - RNA, 1401 nt, Artificial Sequence
  derived and/or modified sequence opt1 from neuraminidase__InfluenzaB__AEA51365
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 89826 - RNA, 1401 nt, Artificial Sequence; identical to SEQ ID NO: 89825
  derived and/or modified sequence opt1 from neuraminidase__InfluenzaB__AEA51367

SEQ ID NO: 89827 - RNA, 1401 nt, Artificial Sequence; identical to SEQ ID NO: 89825
  derived and/or modified sequence opt1 from neuraminidase__InfluenzaB__AEA51371

SEQ ID NO: 89828 - RNA, 1401 nt, Artificial Sequence
  derived and/or modified sequence opt1 from neuraminidase__InfluenzaB__AEA51373
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccaagcggaugggcauggggcuguacgugaaguacgacggcgaccccuggaccgacagcgaggcccuggcgcucuccggggugauggucagcauggaggagccgggcugguacuccuucggguucgagaucaaggacaagaagugcgacgugcccugcaucggcaucgagauggugcacgacggcgggaaggagacguggcacagcgccgccaccgccaucuacugccugaugggcuccgggcagcugcucugggacaccgucaccggcgugaacaugacgcuguga

SEQ ID NO: 89829 - RNA, 1401 nt, Artificial Sequence
  derived and/or modified sequence opt1 from neuraminidase__InfluenzaB__AEA51377
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89830 - RNA, 1401 nt, Artificial Sequence; identical to SEQ ID NO: 89829
  derived and/or modified sequence opt1 from neuraminidase__InfluenzaB__AEA51379

SEQ ID NO: 89831 - RNA, 1401 nt, Artificial Sequence
  derived and/or modified sequence opt1 from neuraminidase__InfluenzaB__AEA51381
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcaugaaguccaagaucggccggugguacagccgcaccauguccaagaccgagcggaugggcauggggcuguacgugaaguacgacggcgaccccugggccgacagcgacgcccuggcguucuccggggugauggucagcgugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 89832 - RNA, 1401 nt, Artificial Sequence; identical to SEQ ID NO: 89829
  derived and/or modified sequence opt1 from neuraminidase__InfluenzaB__AEA51383

SEQ ID NO: 89833 - RNA, 1401 nt, Artificial Sequence
  derived and/or modified sequence opt1 from neuraminidase__InfluenzaB__AEG20998
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgauccugcggcucgcgugcgccaacgccagcaacgugcaggccgugaaccgcuccgccacgaagggcgucacccugcugcuccccgagcccgaguggaccuacccccggcugagcugcccgggguccaccuuccagaaggcgcugcucaucagcccccaccgcuucggcgagacgaaggggaacuccgcgccccugaucauccgggagcccuucaucgccugcggcccgaaggagugcaagcacuucgcccugacccacuacgccgcccagcccggcggguacuacaacggcacccgcgaggaccggaacaagcuccgccaccugaucagcgugaagcuggggaagauccccaccguggagaacuccaucuuccacauggccgccuggagcggcuccgccugccacgacgggcgggaguggacguacaucggcgucgacggccccgacagcaacgcgcuccugaagaucaaguacgggggcgccuucaccgacaccuaccacuccuacgccaagaacauccugagcccgcaggagagcgccugcaacugcaucgggggcgacugcuaccucaugaucaccgacggccccgccuccgggaucagcgagugccgcuuccugaagauccgggagggccgcaucaucaaggagaucuuccccacggggcgggugaagcacaccgaggagugcacgugcggcuucgcguccaacaagaccaucgagugcgccugccgcgacaacagcuacaccgccaagcggcccuucgugaagcugaacgucgagaccgacaccgccgagauccgccucaugugcaccgagacguaccuggacaccccgcggcccaacgacggguccaucaccggccccugcgagagcaacggcgacaagggguccggcgggaucaagggcggguucgugcaccagcgcauggccagcaagaucggccggugguacucccgcaccaugagcaagacgaagcggaugggcauggggcuguacgugaaguacgacggcgaccccuggaccgacuccgaggcgcucgcccugagcggggucaugguguccauggaggagccgggcugguacagcuucggguucgagaucaaggacaagaagugcgacgugcccugcaucggcaucgagaugguccacgacggcgggaagaccaccuggcacuccgccgccacggccaucuacugccugaugggcagcgggcagcuccugugggacaccgugaccggcgugaacaugacccuguga

SEQ ID NO: 89834 - RNA, 1401 nt, Artificial Sequence
  derived and/or modified sequence opt1 from neuraminidase__InfluenzaB__AEG20999
augcugcccagcaccauccagacccucacgcuguuccugaccuccggcggggugcuccugagccuguccgucagcgccucccucagcuaccugcuguacuccgacauccuccugaaguucagccgcaccgagaucaccgccccgaucaugccccuggacugcgcgaacgccuccaacgugcaggccgugaaccggagcgccacgaagggcgucacccuccugcugcccgagcccgaguggaccuacccgcgccucuccugccccgggagcaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucuccgugaagcuggggaagauccccaccguggagaacagcaucuuccacauggccgccugguccggcagcgccugccacgacgggcgcgaguggacguacaucggcgucgacggcccggacuccaacgcccugcucaagaucaaguacgggggcgcguucaccgacaccuaccacagcuacgccaagaacauccugagcccccaggaguccgccugcaacugcaucgggggcgacugcuaccugaugaucaccgacggccccgccagcgggaucuccgagugccgguuccucaagauccgcgagggccggaucaucaaggagaucuuccccacggggcgcgugaagcacaccgaggagugcacgugcggcuucgccagcaacaagaccaucgagugcgcgugccgggacaacuccuacaccgccaagcgcccguucgugaagcugaacgucgagaccgacaccgccgagauccggcugaugugcaccgagacguaccucgacacgccccgccccaacgacgggagcaucaccggccccugcgaguccaacggcgacaaggggagcggcgggaucaagggcggguucgugcaccagcggauggccuccaagaucggccgcugguacagccggaccauguccaagaccaagcgcaugggcauggggcuguacgugaaguacgacggcgacccguggaccgacagcgaggcccuggcgcucuccggggucauggugagcauggaggagcccggcugguacuccuucggguucgagaucaaggacaagaagugcgacgugcccugcaucggcaucgagaugguccacgacggcgggaagaccaccuggcacagcgccgccacggccaucuacugccugaugggcuccgggcagcugcucugggacaccgugaccggcgugaacaugacccuguga

SEQ ID NO: 89835 - RNA, 1401 nt, Artificial Sequence
  derived and/or modified sequence opt1 from neuraminidase__InfluenzaB__AEG21000
augcugcccagcaccauccagacccucacgcuguuccugaccuccggcggggugcuccugagccuguacgucuccgccagccucuccuaccugcuguacagcgacauccuccugaaguucucccgcaccgagaucaccgccgcgauccugauccucgacugcgccaacgccagcaacgugcaggccgugaaccgguccgccacgaagggcgucacccugcugcucccggagcccgaguggaccuacccccgccugagcugccccggguccaccuuccagaaggcgcugcucaucagcccgcaccgguucggcgagacgaaggggaacuccgcgccccugaucauccgcgagcccuucaucgccugcggccccaaggagugcaagcacuucgcccugacccacuacgccgcccagccgggcggguacuacaacggcacccgggaggaccgcaacaagcuccggcaccugaucagcgugaagcuggggaagauccccaccguggagaacuccaucuuccacauggccgccuggagcggcuccgccugccacgacgggcgcgaguggacguacaucggcgucgacggccccgacagcaacgcgcuccugaagaucaaguacgggggcgccuucaccgacaccuaccacuccuacgccaagaacauccugagcccccaggagagcgccugcaacugcaucgggggcgacugcuaccucaugaucaccgacggcccggccuccgggaucagcgagugccgguuccugaagauccgcgagggccggaucaucaaggagaucuuccccacggggcgcgugaagcacaccgaggagugcacgugcggcuucgcguccaacaagaccaucgagugcgccugccgggacaacagcuacaccgccaagcgccccuucgugaagcugaacgucgagaccgacaccgccgagauccggcucaugugcaccgagacguaccuggacacgccccgcccgaacgacggguccaucaccggccccugcgagagcaacggcgacaagggguccggcgggaucaagggcggguucgugcaccagcggauggccagcaagaucggccgcugguacucccggaccaugagcaagaccaagcgcaugggcauggggcuguacgugaaguacgacggcgaccccuggaccgacuccgaggcgcucgcccugagcggggucaugguguccauggaggagcccggcugguacagcuucggguucgagaucaaggacaagaagugcgacgugccgugcaucggcaucgagaugguccacgacggcgggaagaccaccuggcacuccgccgccacggccaucuacugccugaugggcagcgggcagcuccugugggacaccgugaccggcgugaacaugacccuguga

SEQ ID NO: 89836 - RNA, 1401 nt, Artificial Sequence
  derived and/or modified sequence opt1 from neuraminidase__InfluenzaB__AEG21002
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugcgccacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 89837 - RNA, 1401 nt, Artificial Sequence
  derived and/or modified sequence opt1 from neuraminidase__InfluenzaB__AEG21003
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 89838 - RNA, 1401 nt, Artificial Sequence
  derived and/or modified sequence opt1 from neuraminidase__InfluenzaB__AEG21004
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaagggcggcgggggcaucaagggcggguucguccaccagcgcauggagagcaagaucgggcggugguacucccgcaccaugagcaagaccgagcggauggggaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucaccggcguggacauggcccucuga

SEQ ID NO: 89839 - RNA, 1401 nt, Artificial Sequence
  derived and/or modified sequence opt1 from neuraminidase__InfluenzaB__AEG21005
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaagggcggcgggggcaucaagggcggguucguccaccagcgcauggagagcaagaucgggcggugguacucccgcaccaugagcaagaccgagcggauggggaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucaccggcgugaacaugacccucuga

SEQ ID NO: 89840 - RNA, 1401 nt, Artificial Sequence; identical to SEQ ID NO: 89825
  derived and/or modified sequence opt1 from neuraminidase__InfluenzaB__AEG21006

SEQ ID NO: 89841 - RNA, 1401 nt, Artificial Sequence; identical to SEQ ID NO: 89829
  derived and/or modified sequence opt1 from neuraminidase__InfluenzaB__AEG21007

SEQ ID NO: 89842 - RNA, 1401 nt, Artificial Sequence
  derived and/or modified sequence opt1 from neuraminidase__InfluenzaB__AEG21008
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccaagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89843 - RNA, 1401 nt, Artificial Sequence; identical to SEQ ID NO: 89829
  derived and/or modified sequence opt1 from neuraminidase__InfluenzaB__AEG21009

SEQ ID NO: 89844 - RNA, 1401 nt, Artificial Sequence; identical to SEQ ID NO: 89829
  derived and/or modified sequence opt1 from neuraminidase__InfluenzaB__AEG21010

SEQ ID NO: 89845 - RNA, 1401 nt, Artificial Sequence; identical to SEQ ID NO: 89829
  derived and/or modified sequence opt1 from neuraminidase__InfluenzaB__AEG21011

SEQ ID NO: 89846 - RNA, 1401 nt, Artificial Sequence; identical to SEQ ID NO: 89829
  derived and/or modified sequence opt1 from neuraminidase__InfluenzaB__AEG21012

SEQ ID NO: 89847 - RNA, 1401 nt, Artificial Sequence
  derived and/or modified sequence opt1 from neuraminidase__InfluenzaB__AEG21013
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcaugaaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89848 - RNA, 1401 nt, Artificial Sequence
  derived and/or modified sequence opt1 from neuraminidase__InfluenzaB__AEN68957
augcugcccagcaccauccagacccucacgcuguuccugaccuccggcggggugcuccugagccuguacgucuccgccagccucuccuaccugcuguacagcgacauccuccugaaguucucccgcaccgagaucccggcccccaucaugccccuggacugcgcgaacgccagcaacgugcaggccgugaaccgguccgccaccaagggcgucacgcuccugcugcccgagccggaguggaccuacccccgccucagcugccccggguccaccuuccagaaggcccugcugaucagcccccaccgguucggcgagaccaaggggaacuccgcgccgcucaucauccgcgagcccuucaucgccugcggccccaaggagugcaagcacuucgcccugacgcacuacgccgcgcagcccggcggguacuacaacggcacccgggaggaccgcaacaagaugcggcaccugaucagcgugaagcucgggaagaucccgaccguggagaacuccaucuuccacauggccgccuggagcggcuccgccugccacgacgggcgcgaguggaccuacaucggcgucgacggccccgacagcaacgcccugcugaagaucaaguacggggaggcguacacggacaccuaccacuccuacgccaagaacauccuccggacccaggagagcgccugcaacugcaucggcggggacugcuaccugaugaucaccgacggccccgccagcggcaucuccgagugccgcuuccugaagauccgggaggggcgcaucaucaaggagaucuuccccacgggccgggugaaguacaccgaggagugcacgugcggguucgccagcaacaagaccaucggcugcgcgugccgcgacaacuccuacaccgccaagcggccguucgugaagcucaacgucgagaccgacaccgccgagauccgccugaugugcaccgagacguaccuggacacgccccggcccaacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgacccguggaccgacagcgaggcccuggcgcuguccggggucauggugagcauggaggagcccggcugguacuccuucggguucgagaucaaggacaagaagugcgacgugcccugcaucggcaucgagaugguccacgacggcgggaagaccaccuggcacagcgccgccacggccaucuacugccucaugggcuccgggcagcugaugugggacaccgugaccggcgugaacaugacccuguga

SEQ ID NO: 89849 - RNA, 1401 nt, Artificial Sequence
  derived and/or modified sequence opt1 from neuraminidase__InfluenzaB__AEO80071
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89850 - RNA, 1401 nt, Artificial Sequence
  derived and/or modified sequence opt1 from neuraminidase__InfluenzaB__AEO80082
augcugcccagcaccauccagacccucacgcuguuccugaccuccggcggggugcuccugagccuguacgucuccgccagccucuccuaccugcuguacagcgacauccuccugaaguucucccagaccggcaucaccgccccgaucaugccccuggacugcgcgaacgccagcaacgugcaggccgugaaccgcuccgccacgaagggggucacccuccugcugcccgagcccgaguggaccuacccgcggcucagcugccccggcuccaccuuccagaaggcccugcugaucagcccccaccgcuucggggagacgaagggcaacuccgcgccccucaucauccgggagccguucaucgccugcggccccaccgagugcaaguacuucgcccugacccacuacgccgcgcagcccgggggcuacuacaacgggacccgcgaggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacagcaacgcccugcucaagaucaaguacggcgaggcguacaccgacaccuaccacuccuacgccaagaacauccugcggacgcaggagagcgccugcaacugcaucgggggcgacugcuaccugaugaucaccgacggccccgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacgggagcaucacgggccccugcgaguccgacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacggcgggaagacgaccuggcacagcgccgccaccgccaucuacugccugaugggcuccgggcagcugcucugggacaccgugacgggcguggacauggcccuguga

SEQ ID NO: 89851 - RNA, 1401 nt, Artificial Sequence; identical to SEQ ID NO: 89690
  derived and/or modified sequence opt1 from neuraminidase__InfluenzaB__AEO80090

SEQ ID NO: 89852 - RNA, 1401 nt, Artificial Sequence; identical to SEQ ID NO: 89635
  derived and/or modified sequence opt1 from neuraminidase__InfluenzaB__AEO80101

SEQ ID NO: 89853 - RNA, 1401 nt, Artificial Sequence; identical to SEQ ID NO: 89731
  derived and/or modified sequence opt1 from neuraminidase__InfluenzaB__AEO80149

SEQ ID NO: 89854 - RNA, 1401 nt, Artificial Sequence; identical to SEQ ID NO: 89643
  derived and/or modified sequence opt1 from neuraminidase__InfluenzaB__AEO80158

SEQ ID NO: 89855 - RNA, 1401 nt, Artificial Sequence; identical to SEQ ID NO: 89643
  derived and/or modified sequence opt1 from neuraminidase__InfluenzaB__AEO80167

SEQ ID NO: 89856 - RNA, 1401 nt, Artificial Sequence; identical to SEQ ID NO: 89731
  derived and/or modified sequence opt1 from neuraminidase__InfluenzaB__AEO80176

SEQ ID NO: 89857 - RNA, 1401 nt, Artificial Sequence
  derived and/or modified sequence opt1 from neuraminidase__InfluenzaB__AEO80187
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugggcugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaagaucaaguacggggaggcguacaccgacaccuaccacagcuacgccaacaagauccugcggacgcaggaguccgccugcaacugcaucggcggcaacugcuaccugaugaucaccgacgggagcgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacggcagcaucacgggccccugcgaguccaacggggaccgcggcagcgggggcaucaagggcggguucgugcaccagcggauggccuccaagaucggccgcugguacagccggaccauguccaagaccgagcgcauggggaugggccuguacgucaaguacgacggggaccccugggccgacagcgacgcgcuggccuucuccggcgugauggugagcaugaaggagccggggugguacuccuucggcuucgagaucaaggacaagaagugcgacguccccugcaucggcaucgagauggugcacgacgggggcaaggagaccuggcacagcgccgccacggccaucuacugccucaugggguccggccagcugcugugggacaccgugaccggcgucgacauggcgcucuga

SEQ ID NO: 89858 - RNA, 1401 nt, Artificial Sequence
  derived and/or modified sequence opt1 from neuraminidase__InfluenzaB__AEO80198
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgguccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgaccgcgggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 89859 - RNA, 1401 nt, Artificial Sequence; identical to SEQ ID NO: 89799
  derived and/or modified sequence opt1 from neuraminidase__InfluenzaB__AEO80209

SEQ ID NO: 89860 - RNA, 1401 nt, Artificial Sequence
  derived and/or modified sequence opt1 from neuraminidase__InfluenzaB__AEO80220
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggccucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaacgagugcaagcacuucgcccugacccacuacgccgcgcagcccggcggguacuacaacggcacccgcggggaccggaacaagcuccgccaccugaucagcgucaagcugggcaagaucccgacgguggagaccuccaucuuccacauggccgccuggagcggguccgccugccacgacggcaaggaguggaccuacaucggcguggacgggcccgacaacaacgcccuccugaagaucaaguacggcgaggcguacaccgacacguaccacagcuacgccaacaagauccugcggacccaggaguccgccugcaacugcaucgggggcaacugcuaccucaugaucaccgacggcagcgccagcggggucuccgagugccgcuuccugaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgugaagcugaacgucgagaccgacaccgccgagauccgccucaugugcaccgacaccuaccuggacacgccgcggcccgacgacgggagcaucaccggccccugcgaguccaacggcgaccgcgggagcggcgggaucaagggcggguucgugcaccagcggauggccuccaagaucggccgcugguacagccggaccauguccaagaccgagcgcaugggcauggggcuguacgugaaguacgacggcgaccccugggccgacagcgacgcgcucgccuucuccggggucauggugagcaugaaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcgcuguga

SEQ ID NO: 89861 - RNA, 1401 nt, Artificial Sequence; identical to SEQ ID NO: 89796
  derived and/or modified sequence opt1 from neuraminidase__InfluenzaB__AEO80231

SEQ ID NO: 89862 - RNA, 1401 nt, Artificial Sequence; identical to SEQ ID NO: 89799
  derived and/or modified sequence opt1 from neuraminidase__InfluenzaB__AEO80242

SEQ ID NO: 89863 - RNA, 1401 nt, Artificial Sequence; identical to SEQ ID NO: 89643
  derived and/or modified sequence opt1 from neuraminidase__InfluenzaB__AEP20182

SEQ ID NO: 89864 - RNA, 1401 nt, Artificial Sequence
  derived and/or modified sequence opt1 from neuraminidase__InfluenzaB__AEP20193
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcgucaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89865 - RNA, 1401 nt, Artificial Sequence
  derived and/or modified sequence opt1 from neuraminidase__InfluenzaB__AEP20204
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaucaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 89866 - RNA, 1401 nt, Artificial Sequence; identical to SEQ ID NO: 89695
  derived and/or modified sequence opt1 from neuraminidase__InfluenzaB__AEP20215

SEQ ID NO: 89867 - RNA, 1401 nt, Artificial Sequence
  derived and/or modified sequence opt1 from neuraminidase__InfluenzaB__AEP20237
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacgccgccgagauccgccugaugugcacggagaccuaccucgacaccccgcggcccgacgacggguccaucaccggccccugcgagagcaacggcgacaagggguccggcgggaucaagggcggguucgugcaccagcgcauggccagcaagaucggccggugguacucccgcacgaugagcaagaccaagcggaugggcauggggcuguacgugaaguacgacggcgaccccuggaccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcugcucugggacaccgugaccggcguggacauggcgcuguga

SEQ ID NO: 89868 - RNA, 1401 nt, Artificial Sequence; identical to SEQ ID NO: 89695
  derived and/or modified sequence opt1 from neuraminidase__InfluenzaB__AEP20248

SEQ ID NO: 89869 - RNA, 1401 nt, Artificial Sequence
  derived and/or modified sequence opt1 from neuraminidase__InfluenzaB__AEP20259
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaucaucgagugcgcgugccgcgacaacuccuacaccgccaagcggcccuucgucaagcugaacguggagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 89870 - RNA, 1401 nt, Artificial Sequence
  derived and/or modified sequence opt1 from neuraminidase__InfluenzaB__AEP20281
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccaccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacguggagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcccuggcgcucuccggggugauggugagcauggaggagccgggcugguacuccuucggguucgagaucaaggacaagaagugcgacguccccugcaucggcaucgagauggugcacgacggcgggaaggagacguggcacagcgccgccaccgccaucuacugccugaugggcuccgggcagcugcucugggacaccgugaccggcgucgacauggcccuguga

SEQ ID NO: 89871 - RNA, 1401 nt, Artificial Sequence; identical to SEQ ID NO: 89643
  derived and/or modified sequence opt1 from neuraminidase__InfluenzaB__AEP20292

SEQ ID NO: 89872 - RNA, 1401 nt, Artificial Sequence; identical to SEQ ID NO: 89635
  derived and/or modified sequence opt1 from neuraminidase__InfluenzaB__AEP20303

SEQ ID NO: 89873 - RNA, 1401 nt, Artificial Sequence
  derived and/or modified sequence opt1 from neuraminidase__InfluenzaB__AEP20314
augcugcccagcaccauccagacccucacgcuguuccugaccuccggcggggugcuccugagccuguacgucuccgccagccucuccuaccugcuguacagcgacauccuccugaaguucucccagaccggcaucaccgccccgaucaugccccuggacugcgcgaacgccagcaacgugcaggccgugaaccgcuccgccacgaagggggucacccuccugcugcccgagcccgaguggaccuacccgcggcucagcugccccggcuccaccuuccagaaggcccugcugaucagcccccaccgcuucggggagacgaagggcaacuccgcgccccucaucauccgggagccguucaucgccugcggccccaaggagugcaagcacuucgcccugacccacuacgccgcgcagcccgggggcuacuacaacgggacccgcgaggaccggaacaagcugcgccaccucaucagcgugaagcugggcaagauccccaccguggagaacuccaucuuccacauggccgccuggagcggguccgccugccacgacggccgggaguggacguacaucggcgucgacgggccggacagcaacgcccugcucaagaucaaguacggcgaggcguacaccgacaccuaccacuccuacgccaagaacauccugcgcacccaggagagcgccugcaacugcaucgggggcgacugcuaccugaugaucacggacggccccgccagcgggaucuccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacgggagcaucaccggccccugcgaguccaacggcgacaaggggagcggcgggaucaagggcggguucgugcaccagcggauggccuccaagaucggccgcugguacagccggacgauguccaagaccaagcgcaugggcauggggcuguacgugaaguacgacggcgaccccuggaccgacagcgaggcccuggcgcucuccggggucaugaucagcauggaggagccgggcugguacuccuucggguucgagaucaaggacaagaagugcgacgugcccugcaucggcaucgagauggugcacgacggcgggaagaccacguggcacagcgccgccaccgccaucuacugccugaugggcuccgggcagcugcucugggacaccgucaccggcguggacauggcccuguga

SEQ ID NO: 89874 - RNA, 1401 nt, Artificial Sequence
  derived and/or modified sequence opt1 from neuraminidase__InfluenzaB__AEP20336
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcugacccucuccggggugauggugagcauggaggagccgggcugguacuccuucggguucgagaucaaggacaagaagugcgacguccccugcaucggcaucgagauggugcacgacggcgggaaggagacguggcacagcgccgccaccuccaucuacugccugaugggcagcgggcagcugcucugggacaccgugaccggcgucgacauggcccuguga

SEQ ID NO: 89875 - RNA, 1401 nt, Artificial Sequence
  derived and/or modified sequence opt1 from neuraminidase__InfluenzaB__AEP20347
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugccgauggaggagcccgggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 89876 - RNA, 1401 nt, Artificial Sequence; identical to SEQ ID NO: 89875
  derived and/or modified sequence opt1 from neuraminidase__InfluenzaB__AEP20358

SEQ ID NO: 89877 - RNA, 1401 nt, Artificial Sequence; identical to SEQ ID NO: 89875
  derived and/or modified sequence opt1 from neuraminidase__InfluenzaB__AEP20369

SEQ ID NO: 89878 - RNA, 1401 nt, Artificial Sequence; identical to SEQ ID NO: 89875
  derived and/or modified sequence opt1 from neuraminidase__InfluenzaB__AEP20380

SEQ ID NO: 89879 - RNA, 1401 nt, Artificial Sequence
  derived and/or modified sequence opt1 from neuraminidase__InfluenzaB__AEP20391
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaaccgccugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaaggucggccgcugguacagccggaccauguccaagaccgagcgcaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89880 - RNA, 1401 nt, Artificial Sequence
  derived and/or modified sequence opt1 from neuraminidase__InfluenzaB__AEP20413
augcugcccagcaccauccagacccucacgcuguuccugaccuccggcggggugcuccugagccuguacgucuccgcccuccugagcuaccugcucuacuccgacauccugcugaaguucagcccgaccgagaucaucgcccccaccaugucccucgacugcgcgaacgccagcaacgugcaggccgugaaccgcuccgccacgaagggcgucaccuuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggccggacaacgacgcccugcucaaggugaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacaccgccgagauccgccugaugugcacggacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacaacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 89881 - RNA, 1401 nt, Artificial Sequence; identical to SEQ ID NO: 89880
  derived and/or modified sequence opt1 from neuraminidase__InfluenzaB__AEP20435

SEQ ID NO: 89882 - RNA, 1401 nt, Artificial Sequence; identical to SEQ ID NO: 89875
  derived and/or modified sequence opt1 from neuraminidase__InfluenzaB__AEQ39031

SEQ ID NO: 89883 - RNA, 1401 nt, Artificial Sequence
  derived and/or modified sequence opt1 from neuraminidase__InfluenzaB__AEQ39275
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucguccaccagcggauggaguccaagaucggccgcugguacagccggacgauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 89884 - RNA, 1401 nt, Artificial Sequence; identical to SEQ ID NO: 89883
  derived and/or modified sequence opt1 from neuraminidase__InfluenzaB__AEQ39286

SEQ ID NO: 89885 - RNA, 1401 nt, Artificial Sequence; identical to SEQ ID NO: 89883
  derived and/or modified sequence opt1 from neuraminidase__InfluenzaB__AEQ39297

SEQ ID NO: 89886 - RNA, 1401 nt, Artificial Sequence; identical to SEQ ID NO: 89883
  derived and/or modified sequence opt1 from neuraminidase__InfluenzaB__AEQ39308

SEQ ID NO: 89887 - RNA, 1401 nt, Artificial Sequence; identical to SEQ ID NO: 89883
  derived and/or modified sequence opt1 from neuraminidase__InfluenzaB__AEQ39319

SEQ ID NO: 89888 - RNA, 1401 nt, Artificial Sequence
  derived and/or modified sequence opt1 from neuraminidase__InfluenzaB__AEQ39330
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucguccaccagcggauggaguccaagaucggccgcugguacagccggacgauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacaucgcccucuga

SEQ ID NO: 89889 - RNA, 1401 nt, Artificial Sequence; identical to SEQ ID NO: 89883
  derived and/or modified sequence opt1 from neuraminidase__InfluenzaB__AEQ39341

SEQ ID NO: 89890 - RNA, 1401 nt, Artificial Sequence; identical to SEQ ID NO: 89883
  derived and/or modified sequence opt1 from neuraminidase__InfluenzaB__AEQ39352

SEQ ID NO: 89891 - RNA, 1401 nt, Artificial Sequence; identical to SEQ ID NO: 89883
  derived and/or modified sequence opt1 from neuraminidase__InfluenzaB__AEQ39363

SEQ ID NO: 89892 - RNA, 1401 nt, Artificial Sequence; identical to SEQ ID NO: 89849
  derived and/or modified sequence opt1 from neuraminidase__InfluenzaB__AEQ39374

SEQ ID NO: 89893 - RNA, 1401 nt, Artificial Sequence
  derived and/or modified sequence opt1 from neuraminidase__InfluenzaB__AEQ39385
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcaugaccagcaagaucggccggugguacucccgcaccaugagcaagaccaagcggaugggcauggggcuguacgugaaguacgacggcgaccccuggacggacuccgacgcccuggcccucagcggggucaugguguccauggaggagccgggcugguacagcuucggguucgagaucaaggacaagaagugcgacgugcccugcaucggcaucgagaugguccacgacggcgggaaggagaccuggcacuccgcggccaccgccaucuacugccugaugggcagcgggcagcugcucugggacaccgugacgggcguggacauggcccuguga

SEQ ID NO: 89894 - RNA, 1401 nt, Artificial Sequence
  derived and/or modified sequence opt1 from neuraminidase__InfluenzaB__AEQ39444
augcugcccagcaccauccagacccucacgcuguuccugaccuccggcggggugcuccugagccuguacgucuccgccagccucuccuaccugcuguacagcgacauccuccugaaguucucccagaccgagaucaucgccccgaucaugccccuggacugcgcgaacgccagcaacgugcaggccgugaaccgcuccgccaccaagggcgucacgcuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 89895 - RNA, 1401 nt, Artificial Sequence; identical to SEQ ID NO: 89796
  derived and/or modified sequence opt1 from neuraminidase__InfluenzaB__AEQ39455

SEQ ID NO: 89896 - RNA, 1401 nt, Artificial Sequence
  derived and/or modified sequence opt1 from neuraminidase__InfluenzaB__AEQ39466
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaaggucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89897 - RNA, 1401 nt, Artificial Sequence; identical to SEQ ID NO: 89883
  derived and/or modified sequence opt1 from neuraminidase__InfluenzaB__AEQ39477

SEQ ID NO: 89898 - RNA, 1401 nt, Artificial Sequence
  derived and/or modified sequence opt1 from neuraminidase__InfluenzaB__AEQ39488
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggagucccggaucggccgcugguacagccggaccauguccaagaccgagcgcaugggcauggggcuguacgugaaguacgacggcgaccccuggaccgacagcgacgcccuggccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 89899 - RNA, 1401 nt, Artificial Sequence; identical to SEQ ID NO: 89849
  derived and/or modified sequence opt1 from neuraminidase__InfluenzaB__AEQ39499

SEQ ID NO: 89900 - RNA, 1401 nt, Artificial Sequence; identical to SEQ ID NO: 89695
  derived and/or modified sequence opt1 from neuraminidase__InfluenzaB__AEQ39510

SEQ ID NO: 89901 - RNA, 1401 nt, Artificial Sequence
  derived and/or modified sequence opt1 from neuraminidase__InfluenzaB__AEQ49685
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggaccucuga

SEQ ID NO: 89902 - RNA, 1401 nt, Artificial Sequence
  derived and/or modified sequence opt1 from neuraminidase__InfluenzaB__AEQ49686
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89903 - RNA, 1401 nt, Artificial Sequence
  derived and/or modified sequence opt1 from neuraminidase__InfluenzaB__AEQ49687
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89904 - RNA, 1401 nt, Artificial Sequence
  derived and/or modified sequence opt1 from neuraminidase__InfluenzaB__AEQ49688
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccugggcugcgcgaacgccagcaacgugcaggccgugaaccgguccgccacgaagggggucacccuccugcugcccgagcccgaguggaccuacccgcgccucagcugccccggcuccaccuuccagaaggcccugcugaucagcccccaccgguucggggagacgaagggcaacuccgcgccccucaucauccgcgagccguucaucgccugcggccccaaggagugcaagcacuucgcccugacccacuacgccgcgcagcccgggggcuacuacaacgggacccgggaggaccgcaacaagcugcggcaccucaucagcgugaagcugggcaagauccccaccguggagaacuccaucuuccacauggccgccuggagcggguccgccugccacgacggccgcgaguggacguacaucggcgucgacgggccggacagcaacgcccugcucaagaucaaguacggcgaggcguacaccgacaccuaccacuccuacgccaagaacauccugcggacccaggagagcgccugcaacugcaucgggggcgacugcuaccugaugaucacggacggccccgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcgugaacaugacgcuguga

SEQ ID NO: 89905 - RNA, 1401 nt, Artificial Sequence
  derived and/or modified sequence opt1 from neuraminidase__InfluenzaB__AEQ49691
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgaccgcgggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89906 - RNA, 1401 nt, Artificial Sequence
  derived and/or modified sequence opt1 from neuraminidase__InfluenzaB__AEQ49692
augcugcccagcaccauccagacccucacgcuguuccugaccuccggcggggugcuccugagccuguacgucuccgccagccucuccuaccugcuguacagcgacauccuccugaaguucuccccgaccgagaccacggcccccaccaugagccuggacugcgcgaacgccuccaacgugcaggccgugaaccgcagcgccaccaagggcgucaccuuccuccugcccgagcccgaguggacguacccgcggcuguccugccccgggagcaccuuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacgcgcggggaccggaacaagcugcgccaccugaucuccgugaagcucggcaagauccccaccguggagaacagcaucuuccacauggccgccugguccgggagcgccugccacgacggcaaggaguggaccuacaucggcgucgacgggccggacaacgacgcccugcugaaggugaaguacggcgaggcguacaccgacacguaccacuccuacgccaacaagauccuccggacccaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacacggaggagugcacgugcggcuucgccuccaacaagaccaucgagugcgcgugccgcgacaacagcuacaccgccaagcggcccuucgugaagcucaacguggagaccgacaccgccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagacguggcacuccgccgccaccgccaucuacugccugaugggcagcgggcagcuccugugggacaccgucaccggcguggacauggcccuguga

SEQ ID NO: 89907 - RNA, 1401 nt, Artificial Sequence
  derived and/or modified sequence opt1 from neuraminidase__InfluenzaB__AEQ49693
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaaccgcaccaucgagugcgcgugccgggacaacuccuacaccgccaagcgccccuucgugaagcugaacguggagaccgacacggccgagauccggcugaugugcaccgacaccuaccucgacaccccgcgccccaacgacgggagcaucacgggccccugcgaguccgacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89908 - RNA, 1401 nt, Artificial Sequence
  derived and/or modified sequence opt1 from neuraminidase__InfluenzaB__AEQ49695
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89909 - RNA, 1401 nt, Artificial Sequence
  derived and/or modified sequence opt1 from neuraminidase__InfluenzaB__AEQ49697
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucaccuuccuccugcccgagcccgaguggaccuacccgcggcuguccugccccgggagcacguuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucuccgugaagcucggcaagauccccacgguggagaacagcaucuuccacauggccgccugguccgggagcgccugccacgacggcaaggaguggaccuacaucggcgucgacgggccggacaacgacgcccugcugaaggugaaguacggcgaggcguacaccgacaccuaccacuccuacgccaacaagauccuccggacgcaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcucaacguggagaccgacacggccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 89910 - RNA, 1401 nt, Artificial Sequence; identical to SEQ ID NO: 89909
  derived and/or modified sequence opt1 from neuraminidase__InfluenzaB__AEQ49698

SEQ ID NO: 89911 - RNA, 1401 nt, Artificial Sequence; identical to SEQ ID NO: 89909
  derived and/or modified sequence opt1 from neuraminidase__InfluenzaB__AEQ49699

SEQ ID NO: 89912 - RNA, 1401 nt, Artificial Sequence; identical to SEQ ID NO: 89909
  derived and/or modified sequence opt1 from neuraminidase__InfluenzaB__AEQ49700

SEQ ID NO: 89913 - RNA, 1401 nt, Artificial Sequence; identical to SEQ ID NO: 89906
  derived and/or modified sequence opt1 from neuraminidase__InfluenzaB__AEQ49701

SEQ ID NO: 89914 - RNA, 1401 nt, Artificial Sequence; identical to SEQ ID NO: 89909
  derived and/or modified sequence opt1 from neuraminidase__InfluenzaB__AEQ49702

SEQ ID NO: 89915 - RNA, 1401 nt, Artificial Sequence; identical to SEQ ID NO: 89906
  derived and/or modified sequence opt1 from neuraminidase__InfluenzaB__AEQ49703

SEQ ID NO: 89916 - RNA, 1401 nt, Artificial Sequence; identical to SEQ ID NO: 89909
  derived and/or modified sequence opt1 from neuraminidase__InfluenzaB__AEQ49705

SEQ ID NO: 89917 - RNA, 1401 nt, Artificial Sequence
  derived and/or modified sequence opt1 from neuraminidase__InfluenzaB__AEQ49706
augcugcccagcaccauccagaugcucacccuguuccugacgcucggcggggugcugcugucccucuacgucagcgccucccugagcuaccugcucuaccuggacauccugcucaaguucccgcccaccgagaucaccgcccccaccaugccccuggacugcgcgaacgccuccaacgugcaggccgugaaccgcagcgccacgaagggcgucaccuuccugcucccggagcccgaguggaccuacccccggcuguccugccccgggagcaccuuccagaaggcccugcucaucuccccgcaccgcuucggcgagacgaaggggaacagcgcgccccugaucauccgggagcccuucaucgccugcggccccaaggagugcaagcacuucgcccugacccacuacgccgcgcagccgggcggguacuacaacggcacccgcggggaccggaacaagcuccgccaccugaucuccgugaagcugggcaagauccccaccguggagaacagcaucuuccacauggccgccugguccgggagcgccugccacgacggcaaggaguggacguacaucggcgucgacgggcccgacaacaacgcccuccugaagaucaaguacggcgaggcguucaccgacaccuaccacuccuacgccaacaacauccugcggacccaggagagcgccugcaacugcaucgggggcaacugcuaccucaugaucacggacggcuccgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacagcuacaccgccaagcggccguucgucaagcugaacguggagaccgacaccgccgagauccgccucaugugcacggacaccuaccuggacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgacccgugggccgacuccgacgcgcucgccuucagcggggugaugguguccaugaaggagcccggcugguacagcuucggguucgagaucaaggacaagaagugcgacguccccugcaucggcaucgagauggugcacgacggcgggaaggagaccuggcacuccgccgccaccgccaucuacugccugaugggcagcgggcagcugcucugggacacggugaccggcgucaacauggcgcuguga

SEQ ID NO: 89918 - RNA, 1401 nt, Artificial Sequence; identical to SEQ ID NO: 89909
  derived and/or modified sequence opt1 from neuraminidase__InfluenzaB__AEQ49707

SEQ ID NO: 89919 - RNA, 1401 nt, Artificial Sequence; identical to SEQ ID NO: 89909
  derived and/or modified sequence opt1 from neuraminidase__InfluenzaB__AEQ49708

SEQ ID NO: 89920 - RNA, 1401 nt, Artificial Sequence
  derived and/or modified sequence opt1 from neuraminidase__InfluenzaB__AEQ49709
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcaccuccugugggacaccgucaccggcguggacauggcccuguga

SEQ ID NO: 89921 - RNA, 1401 nt, Artificial Sequence; identical to SEQ ID NO: 89883
  derived and/or modified sequence opt1 from neuraminidase__InfluenzaB__AEQ49710

SEQ ID NO: 89922 - RNA, 1401 nt, Artificial Sequence; identical to SEQ ID NO: 89880
  derived and/or modified sequence opt1 from neuraminidase__InfluenzaB__AER27042

SEQ ID NO: 89923 - RNA, 1401 nt, Artificial Sequence; identical to SEQ ID NO: 89908
  derived and/or modified sequence opt1 from neuraminidase__InfluenzaB__AER27053

SEQ ID NO: 89924 - RNA, 1401 nt, Artificial Sequence; identical to SEQ ID NO: 89880
  derived and/or modified sequence opt1 from neuraminidase__InfluenzaB__AER27064

SEQ ID NO: 89925 - RNA, 1401 nt, Artificial Sequence; identical to SEQ ID NO: 89883
  derived and/or modified sequence opt1 from neuraminidase__InfluenzaB__AET43128

SEQ ID NO: 89926 - RNA, 1401 nt, Artificial Sequence; identical to SEQ ID NO: 89883
  derived and/or modified sequence opt1 from neuraminidase__InfluenzaB__AET43139

SEQ ID NO: 89927 - RNA, 1401 nt, Artificial Sequence
  derived and/or modified sequence opt1 from neuraminidase__InfluenzaB__AET43150
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucguccaccagcggauggaguccaagaucggccgcugguacagccggacgauguccaagaccgagcgcaugggcauggggcuguacgugaaguacgacggcgaccccugggccgacagcgacgcccugaccuucuccggggugauggucagcaugaaggagccgggcugguacuccuucggguucgagaucaaggacaagaagugcgacgugcccugcaucggcaucgagauggugcacgacggcgggaaggagaccuggcacagcgcggccacggccaucuacugccucaugggcuccgggcagcugcugugggacaccgucaccggcguggacauggcccucuga

SEQ ID NO: 89928 - RNA, 1401 nt, Artificial Sequence; identical to SEQ ID NO: 89883
  derived and/or modified sequence opt1 from neuraminidase__InfluenzaB__AET43161

SEQ ID NO: 89929 - RNA, 1401 nt, Artificial Sequence; identical to SEQ ID NO: 89883
  derived and/or modified sequence opt1 from neuraminidase__InfluenzaB__AET43172

SEQ ID NO: 89930 - RNA, 1401 nt, Artificial Sequence; identical to SEQ ID NO: 89883
  derived and/or modified sequence opt1 from neuraminidase__InfluenzaB__AET43183

SEQ ID NO: 89931 - RNA, 1401 nt, Artificial Sequence; identical to SEQ ID NO: 89883
  derived and/or modified sequence opt1 from neuraminidase__InfluenzaB__AET43194

SEQ ID NO: 89932 - RNA, 1401 nt, Artificial Sequence; identical to SEQ ID NO: 89883
  derived and/or modified sequence opt1 from neuraminidase__InfluenzaB__AET43216

SEQ ID NO: 89933 - RNA, 1401 nt, Artificial Sequence; identical to SEQ ID NO: 89883
  derived and/or modified sequence opt1 from neuraminidase__InfluenzaB__AET43227

SEQ ID NO: 89934 - RNA, 1401 nt, Artificial Sequence
  derived and/or modified sequence opt1 from neuraminidase__InfluenzaB__AET50947
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucguccaccagcggauggaguccaagaucggccgcugguacagccggacgauguccaagaccgagcgcaugggcauggggcuguacgugaaguacgacggcgaccccugggccgacagcgacgcccuggcguucuccggggugaugaucagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcccucuga

SEQ ID NO: 89935 - RNA, 1401 nt, Artificial Sequence
  derived and/or modified sequence opt1 from neuraminidase__InfluenzaB__AET50958
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagcucgaguggaccuacccgcgccugagcugccccggguccaccuuccagaaggcccugcucaucagcccccaccgguucggcgagacgaaggggaacuccgcgccccugaucauccgcgagccguucaucgccugcggccccaacgagugcaagcacuucgcccugacccacuacgccgcgcagcccggcggguacuacaacggcacccgcggggaccggaacaagcuccggcaccugaucagcgugaagcugggcaagauccccaccguggagaacuccaucuuccacauggccgccuggagcggguccgccugccacgacggcaaggaguggacguacaucggcgucgacgggccggacaacaacgcccuccugaaggugaaguacggcgaggcguacaccgacaccuaccacagcuacgccaacaagauccugcgcacccaggaguccgccugcaacugcaucgggggcaacugcuaccucaugaucacggacggcagcgccagcgggguguccgagugccgguuccugaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcucaugugcacggacaccuaccuggacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccucgcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccugaugggcuccgggcagcugcucugggacacggucaccggcguggacauggcccuguga

SEQ ID NO: 89936 - RNA, 1401 nt, Artificial Sequence; identical to SEQ ID NO: 89883
  derived and/or modified sequence opt1 from neuraminidase__InfluenzaB__AET50969

SEQ ID NO: 89937 - RNA, 1401 nt, Artificial Sequence; identical to SEQ ID NO: 89883
  derived and/or modified sequence opt1 from neuraminidase__InfluenzaB__AET50980

SEQ ID NO: 89938 - RNA, 1401 nt, Artificial Sequence; identical to SEQ ID NO: 89883
  derived and/or modified sequence opt1 from neuraminidase__InfluenzaB__AET74259

SEQ ID NO: 89939 - RNA, 1401 nt, Artificial Sequence; identical to SEQ ID NO: 89883
  derived and/or modified sequence opt1 from neuraminidase__InfluenzaB__AET74270

SEQ ID NO: 89940 - RNA, 1401 nt, Artificial Sequence; identical to SEQ ID NO: 89934
  derived and/or modified sequence opt1 from neuraminidase__InfluenzaB__AET74281

SEQ ID NO: 89941 - RNA, 1401 nt, Artificial Sequence; identical to SEQ ID NO: 89883
  derived and/or modified sequence opt1 from neuraminidase__InfluenzaB__AET74292

SEQ ID NO: 89942 - RNA, 1401 nt, Artificial Sequence; identical to SEQ ID NO: 89883
  derived and/or modified sequence opt1 from neuraminidase__InfluenzaB__AET74303

SEQ ID NO: 89943 - RNA, 1401 nt, Artificial Sequence; identical to SEQ ID NO: 89883
  derived and/or modified sequence opt1 from neuraminidase__InfluenzaB__AET74314

SEQ ID NO: 89944 - RNA, 1401 nt, Artificial Sequence; identical to SEQ ID NO: 89883
  derived and/or modified sequence opt1 from neuraminidase__InfluenzaB__AET74333

SEQ ID NO: 89945 - RNA, 1401 nt, Artificial Sequence
  derived and/or modified sequence opt1 from neuraminidase__InfluenzaB__AET74344
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggaggccgacaccgccgagauccggcugaugugcaccgacacguaccucgacaccccgcgccccgacgacgggagcaucaccggccccugcgaguccaacggcgacaaggggagcggcgggaucaagggcggguucguccaccagcggauggaguccaagaucggccgcugguacagccggaccauguccaagacggagcgcaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacaccgucacgggcguggacauggcgcucuga

SEQ ID NO: 89946 - RNA, 1401 nt, Artificial Sequence; identical to SEQ ID NO: 89883
  derived and/or modified sequence opt1 from neuraminidase__InfluenzaB__AET74355

SEQ ID NO: 89947 - RNA, 1404 nt, Artificial Sequence
  derived and/or modified sequence opt1 from neuraminidase__InfluenzaB__AEY75594
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggacgaagggcggguucgugcaccagcgcauggccuccaagaucggccggugguacagccgcaccauguccaagaccgagcggaagggcauggggcuguacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagacguggcacuccgccgccaccgccaucuacugccucaugggcagcgggcagcugcugugggacaccgugaccggcgucgacauggcccucuga

SEQ ID NO: 89948 - RNA, 1401 nt, Artificial Sequence
  derived and/or modified sequence opt1 from neuraminidase__InfluenzaB__AFA45223
augcugcccagcaccauccagacccucacgcuguuccugaccuccggcggggugcuccugagccuguacgucuccgcccuccugagcuaccugcucuacuccgacauccugccgaaguucagccccaccgagaucaccgcccccacgaugucccuggacugcgcgaacgccagcaacgugcaggccgugaaccgcuccgccaccaagggcgucaccuuccuccugagcgagcccgaguggaccuacccgcggcuguccugccccgggagcacguuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucuccgugaagcucggcaagauccccacgguggagaacagcaucuuccacauggccgccugguccgggagcgccugccacgacggcaaggaguggaccuacaucggcgucgacgggccggacaacgacgcccugcugaaggugaaguacggcgaggcguacaccgacaccuaccacuccuacgccaacaagauccuccggacgcaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcucaacguggagaccgacacggccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 89949 - RNA, 1401 nt, Artificial Sequence
  derived and/or modified sequence opt1 from neuraminidase__InfluenzaB__AFA45226
augcugcccagcaccauccagacccucacgcuguuccugaccuccggcggggugcuccugagccuguacgucuccgccagccucuccuaccugcuguacagcgacauccuccugaaguucuccccgaccgagaccacggcccccaccaugagccuggacugcgcgaacgccuccaacgugcaggccgugaaccgcagcgccaccaagggcgucaccuuccuccugcccgagcccgaguggacguacccgcggcuguccugccccgggagcaccuuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacgcgcggggaccggaacaagcugcgccaccugaucuccgugaagcucggcaaggugcccaccgucgagaacagcaucuuccacauggccgccugguccgggagcgccugccacgacggcaaggaguggaccuacaucggcguggacgggccggacaacgacgcccugcugaaggugaaguacggcgaggcguacaccgacacguaccacuccuacgccaacaagauccuccggacccaggagagcgccugcaacugcaucgggggcaacugcuaccugaugaucaccgacggcagcgccuccggggucagcgagugccgcuuccugaagauccgggagggccgcaucaucaaggagaucuuccccaccgggcgggugaagcacacggaggagugcacgugcggcuucgccuccaacaagaccaucgagugcgcgugccgcgacaacagcuacaccgccaagcggcccuucgugaagcucaacgucgagaccgacaccgccgagauccgccugaugugcaccgacaccuaccuggacacgccccggccggacgacggguccaucaccggccccugcgagagcaacggcgacaagggguccggcgggaucaagggcggguucgugcaccagcgcauggagagcaagaucggccggugguacucccgcaccaugagcaagaccgagcggaugggcauggggcucuacgugaaguacgacggcgaccccugggccgacuccgacgcccuggcguucagcggggucaugguguccaugaaggagcccggcugguacagcuucggguucgagaucaaggacaagaagugcgacgugccgugcaucggcaucgagaugguccacgacggcgggaagggcacguggcacuccgccgccaccgccaucuacugccugauggggagcggccagcuccugugggacaccgugaccggcguggacauggcccuguga

SEQ ID NO: 89950 - RNA, 1401 nt, Artificial Sequence
  derived and/or modified sequence opt1 from neuraminidase__InfluenzaB__AFA45229
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugccccucgacugcgcgaacgccuccaacgugcaggccgugaaccgcagcgccaccaagggcgucaccuuccugcugcccgagccggaguggaccuacccccggcucuccugccccgggagcacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacgacgcccugcucaaggugaaguacggcgaggcguacaccgacaccuaccacuccuacgccaacaagauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcugaacguggagaccgacacggccgagauccgccugaugugcaccgacaccuaccucgacaccccgcggcccgacgacggguccaucacgggccccugcgagagcaacggcgacaagggguccggcgggaucaagggcggguucguccaccagcgcauggagagcaagaucggccggugguacucccgcaccaugagcaagaccgagcggaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 89951 - RNA, 1401 nt, Artificial Sequence; identical to SEQ ID NO: 89903
  derived and/or modified sequence opt1 from neuraminidase__InfluenzaB__AFA45235

SEQ ID NO: 89952 - RNA, 1401 nt, Artificial Sequence
  derived and/or modified sequence opt1 from neuraminidase__InfluenzaB__AFA45238
augcugcccagcaccauccagacccucacgcuguuccugaccuccggcggggugcuccugagccuguacgucuccgccagccucuccuaccugcuguacagcgacauccuccugaaguucuccccgaccaagaccacggcccccaccaugagccuggacugcgcgaacgccuccaacgugcaggccgugaaccgcagcgccaccaagggcgucaccuuccuccugcccgagcccgaguggacguacccgcggcuguccugccccgggagcaccuuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacgcgcggggaccggaacaagcugcgccaccugaucuccgugaagcucggcaagauccccaccguggagaacagcaucuuccacauggccgccugguccgggagcgccugccacgacggcaaggaguggaccuacaucggcgucgacgggccggacaacgacgcccugcugaaggugaaguacggcgaggcguacaccgacacguaccacuccuacgccaacaagauccuccggacccaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacacggaggagugcacgugcggcuucgccuccaacaagaccaucgagugcgcgugccgcgacaacagcuacaccgccaagcggcccuucgugaagcucaacguggagaccgacaccgccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagacguggcacuccgccgccaccgccaucuacugccugaugggcagcgggcagcuccugugggacaccgucaccggcguggacauggcccuguga

SEQ ID NO: 89953 - RNA, 1401 nt, Artificial Sequence
  derived and/or modified sequence opt1 from neuraminidase__InfluenzaB__AFA45241
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaucuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaaggugaaguacggcgaggcguacaccgacaccuaccacagcuacgccaacaagauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucguccaccagcgcauggaguccaagaucggccggugguacagccgcacgauguccaagaccgagcggaugggcauggggcucuacgugaaguacgacggcgaccccugggccgacagcgacgcccugaccuucuccggggugauggucagcaugaaggagccgggcugguacuccuucggguucgagaucaaggacaagaagugcgacgugcccugcaucggcaucgagauggugcacgacggcgggaaggagaccuggcacagcgcggccacggccaucuacugccugaugggcuccgggcagcuccugugggacaccgucaccggcguggacauggcccuguga

SEQ ID NO: 89954 - RNA, 1401 nt, Artificial Sequence
  derived and/or modified sequence opt1 from neuraminidase__InfluenzaB__AFA45244
augcugcccagcaccauccagacccucacgcuguuccugaccuccggcggggugcuccugagccuguacgucuccgccagccucuccuaccugcuguacagcgacauccuccugaaguucuccccgaccgagaccacggcccccaccaugagccuggacugcgcgaacgccuccaacgugcaggccgugaaccgcagcgccaccaagggcgucaccuuccuccugcccgagcccgaguggacguacccgcggcuguccugccccgggagcaccuuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacgcgcggggaccggaacaagcugcgccaccugaucuccgugaagcucggcaagauccccaccguggagaacagcaucuuccacauggccgccugguccgggagcgccugccacgacggcaaggaguggaccuacaucggcgucgacgggccggacaacgacgcccugcugaaggugaaguacggcgaggcguacaccgacacguaccacuccuacgccaacaagauccuccggacccaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacacggaggagugcacgugcggcuucgccuccaacaagaccaucgagugcgcgugccgcgacaacagcuacaccgccaagcggcccuucgugaagcucaacguggagaccgacaccgccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaagaagacguggcacuccgccgccaccgccaucuacugccugaugggcagcgggcagcuccugugggacaccgucaccggcguggacauggcccuguga

SEQ ID NO: 89955 - RNA, 1401 nt, Artificial Sequence
  derived and/or modified sequence opt1 from neuraminidase__InfluenzaB__AFA45247
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacgcgcggggaccggaacaagcugcgccaccucaucagcgugaagcugggcaagauccccaccguggagaacuccaucuuccacauggccgccuggagcggguccgccugccacgacggcaaggaguggaccuacaucggcgucgacgggccggacaacaacgcccugcucaaggugaaguacggcgaggcguacaccgacacguaccacagcuacgccaacaagauccugcggacccaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgugaagcugaacgucgagaccgacaccgccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggucuucuccggggugauggugagcaugaaggagcccggcugguacuccuucggguucgagaucaaggacaagaagugcgacgucccgugcaucggcaucgagauggugcacgacggcgggaaggagacguggcacagcgcggccaccgccaucuacugccucaugggcuccgggcagcugcugugggacaccgugaccggcgucgacauggcccucuga

SEQ ID NO: 89956 - RNA, 1401 nt, Artificial Sequence; identical to SEQ ID NO: 89906
  derived and/or modified sequence opt1 from neuraminidase__InfluenzaB__AFA45250

SEQ ID NO: 89957 - RNA, 1401 nt, Artificial Sequence
  derived and/or modified sequence opt1 from neuraminidase__InfluenzaB__AFA45253
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgugugccgcgacaacuccuacaccgcgaagcggcccuucgugaagcugaacgucgagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggccuucuccggggucauggugagcaugaaggagcccggcugguacuccuucggguucgagaucaaggacaagaagugcgacgugccgugcaucggcaucgagaugguccacgacggcgggaaggagaccuggcacagcgcggccacggccaucuacugccucaugggcuccgggcagcugcugugggacaccgugaccggcguggacauggcccucuga

SEQ ID NO: 89958 - RNA, 1401 nt, Artificial Sequence
  derived and/or modified sequence opt1 from neuraminidase__InfluenzaB__AFB77645
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucguccaccagcgcauggaguccaagaucggccggugguacagccgcacgauguccaagaccgagcggaugggcauggggcuguacgugaaguacgacggcgaccccugggccgacagcgacgcgcugguguucuccggggucauggugagcaugaaggagccgggcugguacuccuucggguucgagaucaaggacaagaagugcgacgugcccugcaucggcaucgagaugguccacgacggcgggaaggagaccuggcacagcgccgccaccgccaucuacugccucaugggcuccgggcagcugcugugggacacggugaccggcguggacauggcccucuga

SEQ ID NO: 89959 - RNA, 1401 nt, Artificial Sequence
  derived and/or modified sequence opt1 from neuraminidase__InfluenzaB__AFB77647
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaucccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucguccaccagcgcauggaguccaagaucggccggugguacagccgcacgauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 89960 - RNA, 1401 nt, Artificial Sequence
  derived and/or modified sequence opt1 from neuraminidase__InfluenzaB__AFB77649
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcggaucaagcacaccgaggagugcacgugcggcuucgcgagcaacaagaccaucgagugcgccugccgcgacaacuccuacaccgccaagcggcccuucgucaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucgugcaccagcgcauggaguccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 89961 - RNA, 1401 nt, Artificial Sequence
  derived and/or modified sequence opt1 from neuraminidase__InfluenzaB__AFB77651
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaccagcgugaagcugggcaagaucccgacgguggagaacuccaucuuccacauggccgccuggagcggguccgccugccacgacggcaaggaguggaccuacaucggcgucgacgggcccgacaacaacgcgcugcucaaggugaaguacggcgaggccuacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 89962 - RNA, 1401 nt, Artificial Sequence
  derived and/or modified sequence opt1 from neuraminidase__InfluenzaB__AFE00364
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgguccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaaccgccugcggcaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccgcacccaggaguccgccugcaacugcaucgggggcaacugcuaccugaugaucacggacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcucaacguggagaccgacaccgccgagauccggcugaugugcacggacaccuaccuggacaccccgcgccccgacgacgggagcaucaccggccccugcgaguccaacggcgacaaggggagcggcgggaucaagggcggguucgugcaccagcggauggccuccaagaucggccgcugguacagccggacgauguccaagaccgagcgcaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 89963 - RNA, 1401 nt, Artificial Sequence
  derived and/or modified sequence opt1 from neuraminidase__InfluenzaB__AFF18536
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugccgccacuucgcccucacccacuacgccgcgcagcccggcggguacuacaacggcacccgcggggaccggaacaagcugcggcaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccgcacccaggaguccgccugcaacugcauccgggggaacugcuaccugaugaucacggacggcagcgccagcggcguguccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacggcagcaucaccgggcccugcgaguccaacggcgacaagggcagcgggggcaucaagggcggguucgugcaccagcgcauggccuccaagaucgggcggugguacagccgcacgauguccaagaccgagcggaagggcaugggccucuacgucaaguacgacggggaccccuggaccgacagcgacgcccuggcguuccgcggcgugaugguguccaugaaggagccggggugguacagcuucggcuucgagaucaaggacaagaagugcgacguccccugcaucgggaucgagauggugcacgacggcggcaaggagaccuggcacuccgccgccacggccaucuacugccugauggggagcggccagcuccugugggacaccgugaccggggucgacauggcccuguga

SEQ ID NO: 89964 - RNA, 1401 nt, Artificial Sequence
  derived and/or modified sequence opt1 from neuraminidase__InfluenzaB__AFF18545
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 89965 - RNA, 1401 nt, Artificial Sequence; identical to SEQ ID NO: 89825
  derived and/or modified sequence opt1 from neuraminidase__InfluenzaB__AFH34933

SEQ ID NO: 89966 - RNA, 1401 nt, Artificial Sequence; identical to SEQ ID NO: 89825
  derived and/or modified sequence opt1 from neuraminidase__InfluenzaB__AFH34939

SEQ ID NO: 89967 - RNA, 1401 nt, Artificial Sequence; identical to SEQ ID NO: 89763
  derived and/or modified sequence opt1 from neuraminidase__InfluenzaB__AFH57869

SEQ ID NO: 89968 - RNA, 1401 nt, Artificial Sequence
  derived and/or modified sequence opt1 from neuraminidase__InfluenzaB__AFH57891
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 89969 - RNA, 1401 nt, Artificial Sequence
  derived and/or modified sequence opt1 from neuraminidase__InfluenzaB__AFH57913
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89970 - RNA, 1401 nt, Artificial Sequence; identical to SEQ ID NO: 89825
  derived and/or modified sequence opt1 from neuraminidase__InfluenzaB__AFH57935

SEQ ID NO: 89971 - RNA, 1401 nt, Artificial Sequence; identical to SEQ ID NO: 89825
  derived and/or modified sequence opt1 from neuraminidase__InfluenzaB__AFH57946

SEQ ID NO: 89972 - RNA, 1401 nt, Artificial Sequence; identical to SEQ ID NO: 89825
  derived and/or modified sequence opt1 from neuraminidase__InfluenzaB__AFH57957

SEQ ID NO: 89973 - RNA, 1401 nt, Artificial Sequence; identical to SEQ ID NO: 89903
  derived and/or modified sequence opt1 from neuraminidase__InfluenzaB__AFH57968

SEQ ID NO: 89974 - RNA, 1401 nt, Artificial Sequence
  derived and/or modified sequence opt1 from neuraminidase__InfluenzaB__AFH57979
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaucuuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggccggacaacgacgcccugcucaaggugaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacaccgccgagauccgccugaugugcacggacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 89975 - RNA, 1401 nt, Artificial Sequence; identical to SEQ ID NO: 89592
  derived and/or modified sequence opt1 from neuraminidase__InfluenzaB__AFH58253

SEQ ID NO: 89976 - RNA, 1401 nt, Artificial Sequence; identical to SEQ ID NO: 89655
  derived and/or modified sequence opt1 from neuraminidase__InfluenzaB__AFH58264

SEQ ID NO: 89977 - RNA, 1401 nt, Artificial Sequence; identical to SEQ ID NO: 89796
  derived and/or modified sequence opt1 from neuraminidase__InfluenzaB__AFH58275

SEQ ID NO: 89978 - RNA, 1401 nt, Artificial Sequence; identical to SEQ ID NO: 89796
  derived and/or modified sequence opt1 from neuraminidase__InfluenzaB__AFH58286

SEQ ID NO: 89979 - RNA, 1401 nt, Artificial Sequence; identical to SEQ ID NO: 89969
  derived and/or modified sequence opt1 from neuraminidase__InfluenzaB__AFH58297

SEQ ID NO: 89980 - RNA, 1401 nt, Artificial Sequence
  derived and/or modified sequence opt1 from neuraminidase__InfluenzaB__AFH58308
augcugcccagcaccauccagacccucacgcuguuccugaccuccggcggggugcuccugagccuguacgucuccgccagccucuccuaccugcuguacagcgacauccuccugaaguucucccgcaccgagaccacggccccgaucaugccccuggacugcgcgaacgccagcaacgugcaggccgugaaccgguccgccaccaagggcgucacccuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccacgguggagaacuccaucuuccacauggccgccuggagcggcuccgccugccacgacgggcgcgaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 89981 - RNA, 1401 nt, Artificial Sequence; identical to SEQ ID NO: 89980
  derived and/or modified sequence opt1 from neuraminidase__InfluenzaB__AFH58319

SEQ ID NO: 89982 - RNA, 1401 nt, Artificial Sequence
  derived and/or modified sequence opt1 from neuraminidase__InfluenzaB__AFH58341
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugcgccuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 89983 - RNA, 1401 nt, Artificial Sequence
  derived and/or modified sequence opt1 from neuraminidase__InfluenzaB__AFH58363
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccgacgacgggagcaucacgggccccugcgaguccaacggcgggaagggcagcgggggcaucaagggcggguucgugcaccagcgcauggccuccaagaucggccggugguacagccgcaccauguccaagaccgagcggaaggggaugggccucuacgugaaguacgacggggaccccugggccgacagcgacgcgcuggccuucuccggcgucauggugagcauggaggagccggggugguacuccuucggcuucgagaucaaggacaagaagugcgacgugcccugcaucggcaucgagaugguccacgacgggggcaaggagaccuggcacagcgccgccacggccaucuacugccugaugggguccggccagcuccugugggacaccgugaccggcgugaacauggcgcuguga

SEQ ID NO: 89984 - RNA, 1401 nt, Artificial Sequence; identical to SEQ ID NO: 89983
  derived and/or modified sequence opt1 from neuraminidase__InfluenzaB__AFH58374

SEQ ID NO: 89985 - RNA, 1401 nt, Artificial Sequence; identical to SEQ ID NO: 89969
  derived and/or modified sequence opt1 from neuraminidase__InfluenzaB__AFH58385

SEQ ID NO: 89986 - RNA, 1401 nt, Artificial Sequence; identical to SEQ ID NO: 89969
  derived and/or modified sequence opt1 from neuraminidase__InfluenzaB__AFH58396

SEQ ID NO: 89987 - RNA, 1401 nt, Artificial Sequence; identical to SEQ ID NO: 89969
  derived and/or modified sequence opt1 from neuraminidase__InfluenzaB__AFH58407

SEQ ID NO: 89988 - RNA, 1401 nt, Artificial Sequence; identical to SEQ ID NO: 89969
  derived and/or modified sequence opt1 from neuraminidase__InfluenzaB__AFH58418

SEQ ID NO: 89989 - RNA, 1401 nt, Artificial Sequence
  derived and/or modified sequence opt1 from neuraminidase__InfluenzaB__AFH58429
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacgagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89990 - RNA, 1401 nt, Artificial Sequence
  derived and/or modified sequence opt1 from neuraminidase__InfluenzaB__AFH58440
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccaggagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacaccccgcgccccaacgacgggagcaucacgggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 89991 - RNA, 1401 nt, Artificial Sequence
  derived and/or modified sequence opt1 from neuraminidase__InfluenzaB__AFH58462
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacaccccgcggcccgacgacgggagcaucacgggccccugcgaguccaacggcgacgaggggagcggcgggaucaagggcggguucguccaccagcgcauggaguccaagaucggccggugguacagccgcaccauguccaagaccgagcggaugggcauggggcucuacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcuccugugggacaccgucaccggcguggacaugacccuguga

SEQ ID NO: 89992 - RNA, 1401 nt, Artificial Sequence; identical to SEQ ID NO: 89991
  derived and/or modified sequence opt1 from neuraminidase__InfluenzaB__AFH58473

SEQ ID NO: 89993 - RNA, 1401 nt, Artificial Sequence; identical to SEQ ID NO: 89825
  derived and/or modified sequence opt1 from neuraminidase__InfluenzaB__AFH58484

SEQ ID NO: 89994 - RNA, 1401 nt, Artificial Sequence; identical to SEQ ID NO: 89825
  derived and/or modified sequence opt1 from neuraminidase__InfluenzaB__AFH58495

SEQ ID NO: 89995 - RNA, 1401 nt, Artificial Sequence; identical to SEQ ID NO: 89825
  derived and/or modified sequence opt1 from neuraminidase__InfluenzaB__AFH58506

SEQ ID NO: 89996 - RNA, 1401 nt, Artificial Sequence
  derived and/or modified sequence opt1 from neuraminidase__InfluenzaB__AFH58517
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcgccugcugugggacaccgucaccggcguggacauggcccucuga

SEQ ID NO: 89997 - RNA, 1401 nt, Artificial Sequence; identical to SEQ ID NO: 89903
  derived and/or modified sequence opt1 from neuraminidase__InfluenzaB__AFH58528

SEQ ID NO: 89998 - RNA, 1401 nt, Artificial Sequence
  derived and/or modified sequence opt1 from neuraminidase__InfluenzaB__AFH58539
augcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaaccacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuacaacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaaguggcugggcggcaucaagggcggguucgugcaccagcggauggccagcaagaucgggcgcugguacucccggaccaugagcaagaccaaccgcaugggcauggagcucuacgugaaguacgacggggaccccuggaccgacuccgacgcccugacccugagcggcgucaugguguccaucgaggagcccggcugguacagcuucggguucgagaucaaggacaagaagugcgacgugccgugcaucggcaucgagaugguccacgacgggggcaaggacaccuggcacuccgcggccaccgccaucuacugccucauggggagcggccagcugcugugggacacggccaccggcguggacauggcccucuga

SEQ ID NO: 89999 - RNA, 1401 nt, Artificial Sequence
  derived and/or modified sequence opt1 from neuraminidase__InfluenzaB__AFH58550
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaaggagaugacccuccugcugcccgagccggaguggaccuacccccggcucagcugccccggcuccacguuccagaaggcccugcugaucagcccccaccgcuucggggagacccggggcaacuccgcgccgcucaccauccgcgagcccuucaucgccugcgggcccaaggagugcaagcacuucgcccugacccacuacgccgcgcagcccggcggcuacuacaacgggacgcgggaggaccgcaacaagcugcggcaccucaucagcgucaagcugggcaagaucccgaccguggagaacuccaucuuccacauggccgccuggagcggguccgccugccacgacggccgcgaguggaccuacaucgggguggacggccccgacagcaacgcccugaucaagaucaaguacggcgaggcguacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuuccccaccgggcgggucgagcacacggaggagugcacgugcggcuucgccuccaacaagaccaucgagugcgcgugccgcgacaacagcuacaccgccaagcggcccuucgugaagcucaacguggagaccgacaccgccgagauccgccugaugugcaccgagaccuaccuggacacgccgcggcccgacgacggguccaucaccggccccugcgagagcaacggggacaagggccgcggcgggaucaagggcggguucguccaccagcggauggccuccaagaucggccgcugguacagccggaccauguccaagaccgagcgcauggggauggagcucuacgugaaguacgacggcgaccccuggacggacagcgaggcccuggcgccguccggcgugauggucagcauggaggagcccgggugguacuccuucggcuucgagaucaaggacaagaagugcgacgugcccugcaucgggaucgagauggugcacgacggcgggaagaagaccuggcacagcgccgccaccgccaucuacugccugaugggcuccggccagcuccugugggacaccgucacggggguggacauggcccuguga

SEQ ID NO: 90000 - RNA, 1401 nt, Artificial Sequence; identical to SEQ ID NO: 89999
  derived and/or modified sequence opt1 from neuraminidase__InfluenzaB__AFH58561

SEQ ID NO: 90001 - RNA, 1401 nt, Artificial Sequence
  derived and/or modified sequence opt1 from neuraminidase__InfluenzaB__AFJ69969
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccuggaccgacagcgacgcccuggccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90002 - RNA, 1401 nt, Artificial Sequence; identical to SEQ ID NO: 89964
  derived and/or modified sequence opt1 from neuraminidase__InfluenzaB__AFJ69971

SEQ ID NO: 90003 - RNA, 1401 nt, Artificial Sequence
  derived and/or modified sequence opt1 from neuraminidase__InfluenzaB__AFJ69973
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgccugccgcuuccugaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaccgacagcgacgcgcuggccuuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcgcuguga

SEQ ID NO: 90004 - RNA, 1401 nt, Artificial Sequence; identical to SEQ ID NO: 89825
  derived and/or modified sequence opt1 from neuraminidase__InfluenzaB__AFJ69975

SEQ ID NO: 90005 - RNA, 1401 nt, Artificial Sequence
  derived and/or modified sequence opt1 from neuraminidase__InfluenzaB__AFJ69979
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacaccagcaacgugcaggccgugaaccacuccgccaccaagggcgucacccuccugcugcccgagccggaguggacguacccccgccucagcugccccggguccaccuuccagaaggcccugcugaucagcccccaccgguucggcgagaccaaggggaacuccgccccgcucaucauccgcgagcccuucaucgcgugcggccccaacgagugcaagcacuucgcccugacccacuacgccgcccagcccggcggguacuacaacggcacgcgcggggaccggaacaagcugcggcaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaaggugaaguacggcgaggccuacaccgacacguaccacagcuacgcgaacaagauccugcgcacccaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacacggaggagugcacgugcggcuucgccagcaacaagaccaucgagugcgccugccgggacaacuccuacaccgcgaagcgccccuucgugaagcugaacguggagaccgacaccgccgagauccggcugaugugcaccgacaccuaccucgacacgccgcgccccgacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90006 - RNA, 1401 nt, Artificial Sequence; identical to SEQ ID NO: 89964
  derived and/or modified sequence opt1 from neuraminidase__InfluenzaB__AFJ69981

SEQ ID NO: 90007 - RNA, 1401 nt, Artificial Sequence
  derived and/or modified sequence opt1 from neuraminidase__InfluenzaB__AFJ69983
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagauccuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgggaagggcagcgggggcaucaagggcggguucgugcaccagcgcauggccuccaagaucggccggugguacagccgcacgauguccaagaccgagcggaaggggaugggccuguacgucaaguacgacggggaccccuggaccgacagcgacgcccuggcguuccgcggcgugaugguguccaugaaggagccggggugguacagcuucggcuucgagaucaaggacaagaagugcgacguccccugcaucggcaucgagauggugcacgacgggggcaaggagaccuggcacuccgccgccacggccaucuacugccucauggggagcggccagcugcugugggacaccgugaccggcgucgacauggcccucuga

SEQ ID NO: 90008 - RNA, 1401 nt, Artificial Sequence
  derived and/or modified sequence opt1 from neuraminidase__InfluenzaB__AFJ69987
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaccaagggcggguucguccaccagcggaugaaguccaagaucggccgcugguacagccggaccaugagcaagaccgagcgcaugggcauggggcuguacgugaaguacgacggcgaccccugggccgacuccgacgcccugacguucagcggggugauggucuccaugaaggagccgggcugguacagcuucggguucgagaucaaggacaagaagugcgacgugcccugcaucggcaucgagauggugcacgacggcgggaaggagaccuggcacuccgcggccaccgccaucuacugccucaugggcagcgggcagcugcugugggacaccgucacgggcguggacauggcccucuga

SEQ ID NO: 90009 - RNA, 1401 nt, Artificial Sequence
  derived and/or modified sequence opt1 from neuraminidase__InfluenzaB__AFJ76228
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccugaacugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaaggagugcaagcacuucgcccugacccacuacgccgcgcagcccgggggcuacuacaacgggacccgcgaggaccggaacaagcugcgccaccucaucagcgugaagcugggcaagaucccgacgguggagaacuccaucuuccacauggccgccuggagcggguccgccugccacgacggccgggaguggaccuacaucggcgucgacgggcccgacagcaacgcccugcucaagaucaaguacggcgaggcguacaccgacaccuaccacuccuacgccaacaacauccugcgcacgcaggagagcgccugcaacugcaucgggggcgacugcuaccugaugaucaccgacggcagcgccuccgggaucagcgagugccgguuccucaagauccgcgagggccggaucaucaaggagaucuuccccaccgggcgcguggagcacaccgaggagugcacgugcggcuucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggguccaucacgggccccugcgagagcaacggcgacaagggguccggcgggaucaagggcggguucgugcaccagcggauggccagcaagaucggccgcugguacucccggaccaugagcaagaccaagcgcaugggcauggggcuguacgugaaguacgacggcgaccccuggaucgacuccgacgcccugacccucagcggggucaugguguccauggaggagccgggcugguacagcuucggguucgagaucaaggacaagaagugcgacgugcccugcaucggcaucgagaugguccacgacggcgggaagaagacguggcacuccgcggccaccgccaucuacugccugaugggcagcgggcagcugcucugggacaccgugaccggcguggacauggcccuguga

SEQ ID NO: 90010 - RNA, 1401 nt, Artificial Sequence; identical to SEQ ID NO: 89676
  derived and/or modified sequence opt1 from neuraminidase__InfluenzaB__AFJ76261

SEQ ID NO: 90011 - RNA, 1401 nt, Artificial Sequence
  derived and/or modified sequence opt1 from neuraminidase__InfluenzaB__AFJ76283
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcggaucaagcacaccgaggagugcacgugcggcuucgccuccaacaagaccaucgagugcgcgugccgcgacaacagcuacaccgccaagcggccguucgugaagcugaacgucgagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgugaaguacgacggcgacccgugggccgacuccgacgcgcugaccuucagcggggucaugguguccauggaggagcccggcugguacagcuucggguucgagaucaaggacaagaagugcgacgugcccugcaucggcaucgagaugguccacgacggcgggaaggagacguggcacuccgccgccaccgccaucuacugccucaugggcagcgggcagcugcugugggacaccgugaccggcgugaacauggcccucuga

SEQ ID NO: 90012 - RNA, 1401 nt, Artificial Sequence
  derived and/or modified sequence opt1 from neuraminidase__InfluenzaB__AFJ76305
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagcgcgcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcaucaagcacaccgaggagugcacgugcggcuucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgugaaguacgacggcgaccccugggccgacagcgacgcgcugaccuucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcguggacauggcccucuga

SEQ ID NO: 90013 - RNA, 1401 nt, Artificial Sequence
  derived and/or modified sequence opt1 from neuraminidase__InfluenzaB__AFJ76316
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcugaccuucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcgugaacauggcccucuga

SEQ ID NO: 90014 - RNA, 1401 nt, Artificial Sequence; identical to SEQ ID NO: 89676
  derived and/or modified sequence opt1 from neuraminidase__InfluenzaB__AFJ76338

SEQ ID NO: 90015 - RNA, 1401 nt, Artificial Sequence
  derived and/or modified sequence opt1 from neuraminidase__InfluenzaB__AFJ77331
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccuacaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90016 - RNA, 1401 nt, Artificial Sequence; identical to SEQ ID NO: 89751
  derived and/or modified sequence opt1 from neuraminidase__InfluenzaB__AFJ77351

SEQ ID NO: 90017 - RNA, 1401 nt, Artificial Sequence; identical to SEQ ID NO: 89643
  derived and/or modified sequence opt1 from neuraminidase__InfluenzaB__AFJ77362

SEQ ID NO: 90018 - RNA, 1401 nt, Artificial Sequence; identical to SEQ ID NO: 89796
  derived and/or modified sequence opt1 from neuraminidase__InfluenzaB__AFJ77384

SEQ ID NO: 90019 - RNA, 1401 nt, Artificial Sequence; identical to SEQ ID NO: 89718
  derived and/or modified sequence opt1 from neuraminidase__InfluenzaB__AFJ80132

SEQ ID NO: 90020 - RNA, 1401 nt, Artificial Sequence
  derived and/or modified sequence opt1 from neuraminidase__InfluenzaB__AFJ80143
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcgggaacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaagaagacguggcacuccgccgccaccgccaucuacugccugauggggagcggccagcugcucugggacaccgugaccgggguggacauggcccuguga

SEQ ID NO: 90021 - RNA, 1401 nt, Artificial Sequence
  derived and/or modified sequence opt1 from neuraminidase__InfluenzaB__AFJ80154
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggccauccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcgaggaccggaacaagcugcgccaccugaucagcgugaagcucgggaagaucccgacgguggagaacuccaucuuccacauggccgccuggagcggcuccgccugccacgacgggcgggaguggaccuacaucggcgucgacggccccgacagcaacgcccugcugaagaucaaguacggggaggcguacaccgacaccuaccacuccuacgccaacaacauccuccgcacgcaggagagcgccugcaacugcaucggcgggaacugcuaccugaugaucaccgacggcagcgccuccggcaucagcgagugccgguuccugaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcucaacgucgagaccgacacggccgagauccggcugaugugcaccgagaccuaccuggacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccucuacgugaaguacgacggggaccccuggaccgacuccgacgcccuggcgcugagcggcgucaugguguccauggaggagccggggugguacagcuucggcuucgagaucaaggacaagaagugcgacgugcccugcaucgggaucgagaugguccacgacggcggcaagaagacguggcacuccgccgccaccgccaucuacugccucauggggagcggccagcugcugugggacaccgugaccgggguggacauggcccucuga

SEQ ID NO: 90022 - RNA, 1401 nt, Artificial Sequence
  derived and/or modified sequence opt1 from neuraminidase__InfluenzaB__AFJ80165
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaucccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaucaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgaccguggagaacuccaucuuccacauggccgccuggagcggcuccgccugccacgacgggaaggaguggacguacaucggcgucgacggccccgacagcaacgcccugcucaagaucaaguacggggaggcguacaccgacaccuaccacuccuacgccaacaacauccugcggacccaggagagcgccugcaacugcaucggcgggaacugcuaccugaugaucacggacggcagcgccuccggcaucagcgagugccgcuuccucaagauccgggaggggcgcaucaucaaggagaucuuccccaccggccggguggagcacaccgaggagugcacgugcggguucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccgacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacauccccugcaucgggaucgagauggugcacgacggcggcaaggagaccuggcacuccgccgccacggccaucuacugccugauggggagcggccagcugcucugggacaccgucaccgggguggacauggcccuguga

SEQ ID NO: 90023 - RNA, 1401 nt, Artificial Sequence
  derived and/or modified sequence opt1 from neuraminidase__InfluenzaB__AFJ80176
augcugcccagcaccauccagacccucacgcuguuccugaccuccggcggggugcuccugagccuguacgucuccgccagccucuccuaccugcuguacagcgacauccuccugaaguucuccccgaccgagaucaccgugcccacgaugccccuggacugcgccaacgcgagcaacgugcaggccgucaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacccgcgaggaccggaacaagcugcgccaccucaucagcgugaagcuggggaagaucccgacggucgagaacuccaucuuccacauggcggccuggagcggcuccgccugccacgacgggcgggaguggaccuacaucggcguggacggccccgacagcaacgcccugcucaagaucaaguacggggaggccuacaccgacaccuaccacuccuacgcgaacaacauccugcgcacgcaggagagcgccugcaacugcaucggcgggaacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgccugccgggacaacagcuacaccgcgaagcgccccuucgucaagcugaacguggagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggauggccagcaagaucgggcgcugguacucccggaccaugagcaagaccaagcgcaugggcaugggccuguacgucaaguacgacggggaccccuggaccgacuccgacgcccuggcccucagcggcgugaugguguccauggaggagccggggugguacagcuucggcuucgagaucaaggacaagaagugcgacguccccugcaucgggaucgagauggugcacgacggcggcaagaagacguggcacuccgcggccaccgccaucuacugccugauggggagcggccagcugcucugggacaccgugaccggggucgacauggcccuguga

SEQ ID NO: 90024 - RNA, 1401 nt, Artificial Sequence
  derived and/or modified sequence opt1 from neuraminidase__InfluenzaB__AFJ80187
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccugaacugcgcgaacgccagcaacuuccaggccgugaaccgcuccgccaccaagggggugacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaaggagugcaagcacuucgcccugacccacuacgccgcgcagcccgggggcuacuacaacgggacccgcgaggaccggaacaagcugcgccaccucaucagcgucaagcugggcaagaucccgacgguggagaacuccaucuuccacauggccgccuggagcggguccgccugccacgacggccgggaguggaccuacaucggcguggacgggcccgacagcaacgcccugcucaagaucaaguacggcgaggcguacaccgacaccuaccacuccuacgccaacaacauccugcgcacgcaggagagcgccugcaacugcaucgggggcgacugcuaccugaugaucaccgacggcagcgccuccgggaucagcgagugccgguuccucaagauccgcgagggccggaucaucaaggagaucuuccccaccgggcgcgucgagcacaccgaggagugcacgugcggcuucgccuccaacaagaccaucgagugcgcgugccgggacaacagcuacaccgccaagcgccccuucgugaagcugaacguggagaccgacacggccgagauccggcugaugugcaccgagaccuaccucgacaccccgcgccccgacgacggguccaucacgggccccugcgagagcaacggcgacaagggguccggcgggaucaagggcggguucguccaccagcggauggccagcaagaucggccgcugguacucccggaccaugagcaagaccaagcgcaugggcauggggcuguacgugaaguacgacggcgaccccuggaucgacuccgacgcccugacccucagcggggugauggucuccauggaggagccgggcugguacagcuucggguucgagaucaaggacaagaagugcgacgugcccugcaucggcaucgagauggugcacgacggcgggaagaagacguggcacuccgcggccaccgccaucuacugccugaugggcagcgggcagcugcucugggacaccgucaccggcguggacauggcccuguga

SEQ ID NO: 90025 - RNA, 1401 nt, Artificial Sequence; identical to SEQ ID NO: 90020
  derived and/or modified sequence opt1 from neuraminidase__InfluenzaB__AFJ80198

SEQ ID NO: 90026 - RNA, 1401 nt, Artificial Sequence; identical to SEQ ID NO: 89648
  derived and/or modified sequence opt1 from neuraminidase__InfluenzaB__AFJ80220

SEQ ID NO: 90027 - RNA, 1401 nt, Artificial Sequence
  derived and/or modified sequence opt1 from neuraminidase__InfluenzaB__AFJ80231
augcugcccagcaccauccagacccucacgcuguuccugaccuccggcggggugcuccugagccuguacgucuccgccagccucuccuaccugcuguacagcggcauccuccugaaguucucccugaccgagaucaccgccccgacgaugccccucaacugcgcgaacgccagcaacgugcaggccgugaaccgcuccgccaccaagggggucacccuguuccugcccgagcccgaguggaccuacccgcggcucagcugccccggcuccacguuccagaaggcccugcugaucagcccccaccgcuucggggagaccaagggcaacuccgcgccccucaucauccgggagccguucaucgccugcggccccaaggagugcaagcacuucgcccugacccacuacgccgcgcagcccgggggcuacuacaacgggacccgcgaggaccggaacaagcugcgccaccucaucagcguggagcugggcaagauccccacgguggagaacuccaucuuccacauggccgccuggagcggguccgccugccacgacggcaaggaguggaccuacaucggcgucgacgggccggacagcaacgcccugcucaagaucaaguacggcgaggcguacaccgacaccuaccacuccuacgccaacaacauccugcggacgcaggagagcgccugcaacugcaucgggggcgacugcuaccugaugaucaccgacggcagcgccuccgggaucagcgagugccgcuuccucaagauccgggagggccgcaucaucaaggagaucuuccccaccgggcggguggagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaucgacuccgacgcccugacccucagcggggucaugguguccauggaggagcccggcugguacagcuucggguucgagaucaaggacaagaagugcgacgugccgugcaucggcaucgagaugguccacgacggcgggaagaagacguggcacuccgcggccaccgccaucuacugccugaugggcagcgggcagcugcucugggacaccgugaccggcguggacauggcccuguga

SEQ ID NO: 90028 - RNA, 1401 nt, Artificial Sequence
  derived and/or modified sequence opt1 from neuraminidase__InfluenzaB__AFJ80242
augcugcccagcaccauccagacccucacgcuguuccugaccuccggcggggugcuccugagccuguacgucuccgcccuccugagcuaccugcucuacuccgacauccugcugaaguucagcccgaccaaggugaucgcccccaccaugucccucgacugcgcgaacgccagcaacgugcaggccgucaaccacuccgccacggaggagaugaccuuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacgcacuacgccgcccagcccggcggcuacuacaacgggacccgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacacggacaccuaccacuccuacgccaacaacauccuccggacccaggagagcgccugcaacugcaucgggggcgacugcuaccugaugaucaccgacgggagcgccuccggcaucagccgcugccgguuccugaagauccgcgagggccggaucaucaaggagaucuucccgacggggcgcguggagcacaccgaggagugcacgugcggcuucgcguccaacaagaccaucgagugcgccugccgggacaacagcuacaccgccaagcgccccuucgugaagcucaacgucgagaccgacaccgccgagauccggcugaugugcaccgagacguaccuggacacgccccgccccgacgacggguccaucaccggcccgugcgagagcaacggggacaagggcaacggcgggaucaagggcggguucgugcaccagcggauggccucccgcaucggccggugguacagccgcaccauguccaagaccaagcggauggggauggagcucuacgugaaguacgacggcgaccccuggaccgacagcgacgcgcuggcccccuccggcgucauggugagcauggaggagcccgggugguacuccuucggcuucgagaucaaggacaagaagugcgacgugccgugcaucgggaucgagaugguccacgacggcgggaagaccaccuggcacagcgccgccacggccaucuacugccugaugggcuccggccagcuccugugggacaccgugaccgggguggacauggcgcuguga

SEQ ID NO: 90029 - RNA, 1401 nt, Artificial Sequence
  derived and/or modified sequence opt1 from neuraminidase__InfluenzaB__AFJ80660
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcguggagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggcuccaucacggggcccugcgagagcaacggcgacaagggcuccgggggcaucaagggcggguucgugcaccagcggaugaccagcaagaucgggcgcugguacucccggaccaugagcaagaccaagcgcaugggcaugggccuguacgugaaguacgacggggaccccuggacggacuccgacgcccuggcccucagcggcgucaugguguccauggaggagccggggugguacagcuucggcuucgagaucaaggacaagaagugcgacgugcccugcaucgggaucgagaugguccacgacggcggcaagaagaccuggcacuccgcggccaccgccaucuacugccugauggggagcggccagcugcucugggacaccgugacggggguggacauggcccuguga

SEQ ID NO: 90030 - RNA, 1401 nt, Artificial Sequence; identical to SEQ ID NO: 90027
  derived and/or modified sequence opt1 from neuraminidase__InfluenzaB__AFJ80671

SEQ ID NO: 90031 - RNA, 1401 nt, Artificial Sequence; identical to SEQ ID NO: 90027
  derived and/or modified sequence opt1 from neuraminidase__InfluenzaB__AFJ80682

SEQ ID NO: 90032 - RNA, 1401 nt, Artificial Sequence
  derived and/or modified sequence opt1 from neuraminidase__InfluenzaB__AFJ80693
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccugaacugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaaggagugcaagcacuucgcccugacccacuacgccgcgcagcccgggggcuacuacaacgggacccgcgaggaccggaacaagcugcgccaccucaucagcgugaagcugggcaagaucccgacgguggagaacuccaucuuccacauggccgccuggagcggguccgccugccacgacggccgggaguggaccuacaucggcgucgacgggcccgacagcaacgcccugcucaagaucaaguacggcgaggcguacaccgacaccuaccacuccuacgccaacaacauccugcgcacgcaggagagcgccugcaacugcaucgggggcgacugcuaccugaugaucaccgacggcagcgccuccgggaucagcgagugccgguuccucaagauccgcgagggccggaucaucaaggagaucuuccccaccgggcgcguggagcacaccgaggagugcacgugcggcuucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggguccaucacgggccccugcgagagccacggcgacaagggguccggcgggaucaagggcggguucgugcaccagcggauggccagcaagaucggccgcugguacucccggaccaugagcaagaccaagcgcaugggcauggggcuguacgugaaguacgacggcgaccccuggaucgacuccggggcccugacccucagcggcgucaugguguccauggaggagccggggugguacagcuucggcuucgagaucaaggacaagaagugcgacgugcccugcaucggcaucgagaugguccacgacgggggcaagaagacguggcacuccgcggccaccgccaucuacugccugauggggagcggccagcugcucugggacaccgugaccggcguggacauggcccuguga

SEQ ID NO: 90033 - RNA, 1401 nt, Artificial Sequence
  derived and/or modified sequence opt1 from neuraminidase__InfluenzaB__AFJ80726
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccgaacgacggcuccaucaccgggcccugcgagagcaacggcgaccggggcgggggcgggaucaagggcggguucgugcaccagcgcauggccuccaagaucggccggugguacagccgcaccauguccaagaccaagcggaugggcauggggcuguacgugaaguacgacggcgaccccuggaccgacagcgaggcccuggcgcucuccggggucauggugcccauggaggagccgggcugguacagcuucggguucgagaucaaggacaagaagugcgacgugcccugcaucggcaucgagaugguccacgacggcgggaagacgaccuggcacuccgccgccaccgccaucuacugccugaugggcagcgggcagcugcucugggacaccgugacgggcguggacauggcccuguga

SEQ ID NO: 90034 - RNA, 1401 nt, Artificial Sequence
  derived and/or modified sequence opt1 from neuraminidase__InfluenzaB__AFJ80737
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcauccggggcgacugcuaccugaugaucacggacgggcccgccagcggcaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccaacggggacaagggcagcggcgggaucaagggcggguucgugcaccagcgcauggccuccaagaucggccggugguacagccgcacgauguccaagaccaagcggauggggaugggccuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacgggggcaagaccacguggcacagcgccgccaccgccaucuacugccugaugggcuccgggcagcugcucugggacaccgugaccggcguggacauggcccuguga

SEQ ID NO: 90035 - RNA, 1401 nt, Artificial Sequence; identical to SEQ ID NO: 89676
  derived and/or modified sequence opt1 from neuraminidase__InfluenzaB__AFJ80759

SEQ ID NO: 90036 - RNA, 1401 nt, Artificial Sequence
  derived and/or modified sequence opt1 from neuraminidase__InfluenzaB__AFJ80770
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcuggacgucgagaccgacacggccgagauccggcugaugugcaccgagaccuaccucgacaccccgcgccccaacgacggcagcaucacggggcccugcgaguccaacggcgacaagggcagcgggggcaucaagggcggguucgugcaccagcggauggccuccaagaucgggcgcugguacagccggacccuguccaagaccaagcgcaugggcaugggccuguacgugaaguacgacggggaccccuggaccgacagcgaggcccucgcgcuguccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcuccugugggacaccgugacggggguggacauggcccuguga

SEQ ID NO: 90037 - RNA, 1401 nt, Artificial Sequence; identical to SEQ ID NO: 89676
  derived and/or modified sequence opt1 from neuraminidase__InfluenzaB__AFJ80785

SEQ ID NO: 90038 - RNA, 1401 nt, Artificial Sequence; identical to SEQ ID NO: 89676
  derived and/or modified sequence opt1 from neuraminidase__InfluenzaB__AFJ80796

SEQ ID NO: 90039 - RNA, 1401 nt, Artificial Sequence
  derived and/or modified sequence opt1 from neuraminidase__InfluenzaB__AFJ80807
augcugcccagcaccauccagacccucacgcuguuccugaccuccggcggggugcuccugagccuguacgucuccgugagccucuccuaccugcuguacagcgacauccuccugaaguucccguccaccgagaucaccgcccccacgaugccccuggacugcgccaacgcgagcaacgugcaggccgucaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacccgcggggaccggaacaagcugcgccaccucaucagcgugaagcugggcaagaucccgacggucgagaacuccaucuuccacauggcggccuggagcggguccgccugccacgacggcaaggaguggaccuacaucggcguggacgggcccgacaacaacgcccugcucaagaucaaguacggcgaggccuacaccgacaccuaccacagcuacgcgaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgccugccgcgacaacuccuacaccgcgaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcccuggcguucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucaacauggcccucuga

SEQ ID NO: 90040 - RNA, 1401 nt, Artificial Sequence; identical to SEQ ID NO: 89676
  derived and/or modified sequence opt1 from neuraminidase__InfluenzaB__AFJ80818

SEQ ID NO: 90041 - RNA, 1401 nt, Artificial Sequence; identical to SEQ ID NO: 89676
  derived and/or modified sequence opt1 from neuraminidase__InfluenzaB__AFJ80829

SEQ ID NO: 90042 - RNA, 1401 nt, Artificial Sequence; identical to SEQ ID NO: 90013
  derived and/or modified sequence opt1 from neuraminidase__InfluenzaB__AFJ80840

SEQ ID NO: 90043 - RNA, 1401 nt, Artificial Sequence; identical to SEQ ID NO: 90013
  derived and/or modified sequence opt1 from neuraminidase__InfluenzaB__AFJ80851

SEQ ID NO: 90044 - RNA, 1401 nt, Artificial Sequence
  derived and/or modified sequence opt1 from neuraminidase__InfluenzaB__AFJ80862
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccaugaaccgcuccgccaccaagggcgugacccuccugcugcccgagaccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcggggaccggaacaagcugcgccaccucaucagcgucaagcugggcaagauccccaccguggagaacuccaucuuccacauggccgccuggagcggguccgccugccacgacggcaaggaguggaccuacaucggcguggacgggccggacaacaacgcccugcucaagaucaaguacggcgaggcguacaccgacacguaccacagcuacgccaacaacauccugcggacccaggaguccgccugcaacugcaucgggggcaacugcuaccugaugaucaccgacggcagcgccagcggggucuccgagugccgcuuccucaagauccgggagggccgcaucaucaaggagaucuuccccaccgggcggaucaagcacacggaggagugcacgugcggcuucgccagcaacaagaccaucgagugcgcgugccgcgacaacuccuacaccgccaagcggcccuucgugaagcugaacguggagaccgacaccgccgagauccgccugaugugcaccgagaccuaccucgacacgccccggccggacgacgggagcaucaccggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcugacguucuccggggugauggucagcauggaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacaccgucacgggcgugaacauggcccucuga

SEQ ID NO: 90045 - RNA, 1401 nt, Artificial Sequence
  derived and/or modified sequence opt1 from neuraminidase__InfluenzaB__AFJ80873
augcugcccagcaccauccagacccucacgcuguuccugaccuccggcggggugcuccugagccuguacgucuccgccagccucucccaccuccuguacagcggcauccugcugaaguucccguccaccgagaucaccgcccccacgaugccccuggacugcgcgaacgccagcaacgugcaggccgugaaccgcuccgccaccaagggggucacccuccugcccccggagcccgaguggaccuacccccggcugagcugccccggcuccacguuccagaaggcccuccugaucagcccgcaccgcuucggggagaccaagggcaacuccgcgccccugaucauccgggagcccuucaucgccugcggccccaaggagugcaagcacuucgcccucacccacuacgccgcgcagcccgggggcuacuacaacgggacccgcggcgaccggaacaagcugcgccaccugaucagcgugaagcucgggaagauccccacgguggagaacuccaucuuccacauggccgccuggagcggcuccgccugccacgacggcaaggaguggaccuacaucggggucgacggccccgacaacaacgcccugcugaagaucaaguacggggaggcguacaccgacaccuaccacagcuacgccaacaacauccuccggacgcaggaguccgccugcaacugcaucggcggcaacugcuaccugaugaucaccgacgggagcgccagcggcguguccgagugccgcuuccugaagauccgggaggggcgcaucaucaaggagaucuuccccaccggccggaucaagcacaccgaggagugcacgugcggguucgccagcaacaagaccaucgagugcgcgugccgcgacaacuccuacaccgccaagcggccguucgugaagcucaacgucgagaccgacacggccgagauccgccugaugugcaccgagaccuaccuggacaccccgcggcccgacgacggcagcaucacgggccccugcgaguccaacggggacaagggcagcgggggcaucaagggcggguucgugcaccagcgcauggccuccaagaucggccggugguacagccgcaccauguccaagaccgagcggauggggaugggccucuacgugaaguacgacggggacccgugggccgacagcgacgcgcugaccuucuccggcgucauggugagcauggaggagcccgggugguacuccuucggcuucgagaucaaggacaagaagugcgacgugcccugcaucggcaucgagaugguccacgacgggggcaaggagacguggcacagcgccgccaccgccaucuacugccugaugggguccggccagcuccugugggacaccgugaccggcgugaacauggcccuguga

SEQ ID NO: 90046 - RNA, 1401 nt, Artificial Sequence
  derived and/or modified sequence opt1 from neuraminidase__InfluenzaB__AFJ80884
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccaagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcugaccuucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcgugaacauggcccucuga

SEQ ID NO: 90047 - RNA, 1401 nt, Artificial Sequence; identical to SEQ ID NO: 90012
  derived and/or modified sequence opt1 from neuraminidase__InfluenzaB__AFJ80895

SEQ ID NO: 90048 - RNA, 1401 nt, Artificial Sequence
  derived and/or modified sequence opt1 from neuraminidase__InfluenzaB__AFJ80917
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcacgugccgcgacaacuccuacaccgcgaagcggcccuucgugaagcugaacgucgagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcccugacguucuccggggucauggugagcauggaggagccgggcugguacuccuucggguucgagaucaaggacaagaagugcgacgugcccugcaucggcaucgagaugguccacgacggcgggaaggagaccuggcacagcgcggccaccgccaucuacugccucaugggcuccgggcagcugcugugggacaccgugacgggcgugaacauggcccucuga

SEQ ID NO: 90049 - RNA, 1401 nt, Artificial Sequence
  derived and/or modified sequence opt1 from neuraminidase__InfluenzaB__AFJ80928
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcgagcccaaggagugcaagcacuucgcccugacccacuacgccgcgcagcccggcggcuacuacaacgggacccgcggcgaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcggacgcaggaguccgccugcaacugcaucggcgggaacugcuaccugaugaucaccgacggcagcgccagcggcguguccgagugccgcuuccucaagauccgggaggggcgcaucaucaaggagaucuuccccaccggccggaucaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacggcagcaucacggggcccugcgaguccaacggcgacaagggcagcgggggcaucaagggcggguucgugcaccagcgcauggccuccaagaucgggcggugguacagccgcaccauguccaagaccgagcggaugggcaugggccuguacgugaaguacgacggggaccccugggccgacagcgacgcgcugaccuucuccggcgucauggugagcauggaggagccggggugguacuccuucggcuucgagaucaaggacaagaagugcgacgugcccugcaucgggaucgagaugguccacgacggcggcaaggagacguggcacagcgccgccaccgccaucuacugccucaugggguccggccagcugcugugggacaccgugaccggggugaacauggcccucuga

SEQ ID NO: 90050 - RNA, 1401 nt, Artificial Sequence
  derived and/or modified sequence opt1 from neuraminidase__InfluenzaB__AFJ80939
augcugcccagcaccauccagacccucacgcuguuccugaccuccggcggggugcuccugagccuguacgucuccgccagccucuccuaccugcuguacagcgacauccuccugaaguucccgcccaccgaggugaccgcccccacgaugccccuggacugcgcgaacgccuccaacgugcaggccgucaaccgcagcgccaccaagggcgugacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacggucgagaacagcaucuuccacauggccgccugguccgggagcgccugccacgacggcaaggaguggaccuacaucggcguggacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcggaucaagcacaccgaggagugcacgugcggcuucgccuccaacaagaccaucgagugcgcgugccgcgacaacagcuacaccgccaagcggccguucgucaagcugaacguggagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgacccgugggccgacuccgacgcgcugaccuucagcggggugaugguguccauggaggagcccggcugguacagcuucggguucgagaucaaggacaagaagugcgacguccccugcaucggcaucgagauggugcacgacggcgggaaggagacguggcacuccgccgccaccgccaucuacugccucaugggcagcgggcagcugcugugggacaccgugaccggcgucaacauggcccucuga

SEQ ID NO: 90051 - RNA, 1401 nt, Artificial Sequence
  derived and/or modified sequence opt1 from neuraminidase__InfluenzaB__AFJ80950
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcaacgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcgcuggcccucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcgcuguga

SEQ ID NO: 90052 - RNA, 1401 nt, Artificial Sequence; identical to SEQ ID NO: 90013
  derived and/or modified sequence opt1 from neuraminidase__InfluenzaB__AFJ80961

SEQ ID NO: 90053 - RNA, 1401 nt, Artificial Sequence; identical to SEQ ID NO: 89796
  derived and/or modified sequence opt1 from neuraminidase__InfluenzaB__AFJ80972

SEQ ID NO: 90054 - RNA, 1401 nt, Artificial Sequence; identical to SEQ ID NO: 89796
  derived and/or modified sequence opt1 from neuraminidase__InfluenzaB__AFJ80983

SEQ ID NO: 90055 - RNA, 1401 nt, Artificial Sequence; identical to SEQ ID NO: 89751
  derived and/or modified sequence opt1 from neuraminidase__InfluenzaB__AFJ80994

SEQ ID NO: 90056 - RNA, 1401 nt, Artificial Sequence; identical to SEQ ID NO: 89796
  derived and/or modified sequence opt1 from neuraminidase__InfluenzaB__AFJ81005

SEQ ID NO: 90057 - RNA, 1401 nt, Artificial Sequence; identical to SEQ ID NO: 89796
  derived and/or modified sequence opt1 from neuraminidase__InfluenzaB__AFJ84364

SEQ ID NO: 90058 - RNA, 1401 nt, Artificial Sequence
  derived and/or modified sequence opt1 from neuraminidase__InfluenzaB__AFJ90399
augcugcccagcaccauccagacccucacgcuguuccugaccuccggcggggugcuccugagccuguacgucuccgccagccucuccuaccugcuguacagcgacauccuccugaaguucccguccaccgagaucaccgccccgcccaugccccuggacugcgcgaacgccagcaacgugcaggccgugaaccgcuccgccacgaagggcgucacccuccugcugcccgagcccgaguggaccuacccccggcucagcugccccggguccaccuuccagcgcgcccugcugaucagcccgcaccgguucggcgagacgaaggggaacuccgcgccccucaucauccgcgagcccuucaucgccugcggcccccgggagugcaagcacuucgcccugacccacuacgccgcgcagccgggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggccguucgugaagcugaacgucgagaccgacaccgccgagauccgccugaugugcacggagaccuaccucgacacgccccggcccgacgacgggagcaucaccggccccugcgaguccaacggcgacaaggggagcggcgggaucaagggcggguucgugcaccagcgcaugaccuccaagaucggccggugguacagccgcaccauguccaagaccgagcggaugggcauggggcuguacgugaaguacgacggcgacccgugggccgacagcgacgcccugaccuucuccggggucauggugagcauggaggagcccggcugguacuccuucggguucgagaucaaggacaagaagugcgacgugcccugcaucggcaucgagaugguccacgacggcgggaaggagacguggcacagcgcggccaccgccaucuacugccucaugggcuccgggcagcugcugugggacaccgugaccggcgugaacauggcccucuga

SEQ ID NO: 90059 - RNA, 1401 nt, Artificial Sequence
  derived and/or modified sequence opt1 from neuraminidase__InfluenzaB__AFJ90410
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccaagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaaccugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90060 - RNA, 1401 nt, Artificial Sequence
  derived and/or modified sequence opt1 from neuraminidase__InfluenzaB__AFJ90432
augcugcccagcaccauccagacccucacgcuguuccugaccuccggcggggugcuccugagccuguacgucuccaccagccucuccuaccugcuguacagcgacauccuccugaaguucucccagaccgagaucacggccccgaucaugccccuggacugcgccaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 90061 - RNA, 1401 nt, Artificial Sequence; identical to SEQ ID NO: 89980
  derived and/or modified sequence opt1 from neuraminidase__InfluenzaB__AFJ90443

SEQ ID NO: 90062 - RNA, 1401 nt, Artificial Sequence
  derived and/or modified sequence opt1 from neuraminidase__InfluenzaB__AFJ90454
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucgugccccuggacugcgcgaacgccagcaacgugcaggccgucaaccgcuccgccgccaagggcgugacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcgaguacuacaacgggacccgcgaggaccggaacaagcugcgccaccucaucagcgugaagcugggcaagauccccaccgucgagaacuccaucuuccacauggccgccuggagcggguccgccugccacgacggcaaggaguggacguacaucgggguggacggcccggacagcaacgcgcugcucaagaucaaguacggcgaggccuacaccgacaccuaccacuccuacgccaagaacauccugcggacccaggagagcgccugcaacugcaucgggggcgacugcuaccugaugaucacggacgggcccgccagcggcaucuccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacgggagcaucaccggccccugcgaguccgacggggacaagggcagcggcgggaucaagggcggguucgugcaccagcgcauggccuccaagaucggccggugguacagccgcacgauguccaagaccaagcggauggggaugggccuguacgucaaguacgacggcgaccccuggaccgacagcgaggcgcuggcccucuccggggugauggugagcauggaggagccgggcugguacuccuucggguucgagaucaaggacaagaagugcgacguccccugcaucggcaucgagauggugcacgacgggggcaagaccacguggcacagcgccgccaccgccaucuacugccugaugggcuccgggcagcugcucugggacaccgugaccggcgucgacauggcgcuguga

SEQ ID NO: 90063 - RNA, 1401 nt, Artificial Sequence
  derived and/or modified sequence opt1 from neuraminidase__InfluenzaB__AFJ91042
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugauccccgagcccgaguggaccuacccgcggcugagcugccccggguccaccuuccagaaggcgcuccugaucagcccccaccgcuucggcgagaccaaggggaacuccgcgccccugaucauccgggagccguucaucgccugcggccccacggagugcaagcacuucgcccucacccacuacgccgcccagcccggcggguacuacaacggcacccgcgaggaccggaacaagcugcgccaccugaucagcgugaagcucgggaagauccccaccguggagaacuccaucuuccacauggccgccuggagcggcuccgccugccacgacgggaaggaguggacguacaucggcgucgacggcccggacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcucaacgucgagaccgacaccgccgagauccgccugaugugcacggagaccuaccuggacaccccgcggcccaacgacggcagcaucgccgggcccugcgaguccgacggcgacaagggcagcgggggcaucaagggcggguucgugcaccagcgcaugaccuccaagaucgggcggugguacagccgcacgauguccaagaccaagcggaugggcaugggccucuacgugaaguacgacggggaccccuggaccgacagcgaggcgcuggcccuguccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccgggguggacauggcgcucuga

SEQ ID NO: 90064 - RNA, 1401 nt, Artificial Sequence
  derived and/or modified sequence opt1 from neuraminidase__InfluenzaB__AFJ91053
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaaggaggucacgcuccugcugcccgagcccgaguggaccuacccgcggcucagcugccccggcuccaccuuccagaaggcgcugcugaucagcccccaccgcuucggggagaccaagggcaacuccgcgccccucaucauccgggagccguucaucgccugcgggcccacggagugcaagcacuucgcccugacccacuacgccgcccagcccggcggcuacuacaacgggacccgcgaggaccggaacaagcugcgccaccucaucagcgugaagcugggcaagauccccaccguggagaacuccaucuuccacauggccgccuggagcggguccgccugccacgacggcaaggaguggacguacaucggggucgacggcccggacagcaacgcgcugcucaagaucaaguacggcgaggccuacaccgacaccuaccacuccuacgccaagaacauccugcggacccaggagagcgccugcaacugcaucgggggcgacugcuaccugaugaucacggacgggcccgccagcggcaucuccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccgacggggacaagggcagcggcgggaucaagggcggguucgugcaccagcgcauggccuccaagaucggccggugguacagccgcacgauguccaagaccaagcggauggggaugggccuguacgugaaguacgacggcgaccccuggaccgacagcgaggcgcuggcccucuccggggucauggugagcauggaggagccgggcugguacuccuucggguucgagaucaaggacaagaagugcgacgugcccugcaucggcaucgagaugguccacgacgggggcaagaccacguggcacagcgccgccaccgccaucuacugccugaugggcuccgggcagcugcucugggacaccgugaccggcguggacauggcgcuguga

SEQ ID NO: 90065 - RNA, 1401 nt, Artificial Sequence
  derived and/or modified sequence opt1 from neuraminidase__InfluenzaB__AFJ91075
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacacccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 90066 - RNA, 1401 nt, Artificial Sequence; identical to SEQ ID NO: 89825
  derived and/or modified sequence opt1 from neuraminidase__InfluenzaB__AFJ91086

SEQ ID NO: 90067 - RNA, 1401 nt, Artificial Sequence; identical to SEQ ID NO: 89825
  derived and/or modified sequence opt1 from neuraminidase__InfluenzaB__AFJ91097

SEQ ID NO: 90068 - RNA, 1401 nt, Artificial Sequence; identical to SEQ ID NO: 89825
  derived and/or modified sequence opt1 from neuraminidase__InfluenzaB__AFJ91108

SEQ ID NO: 90069 - RNA, 1401 nt, Artificial Sequence; identical to SEQ ID NO: 89825
  derived and/or modified sequence opt1 from neuraminidase__InfluenzaB__AFJ91119

SEQ ID NO: 90070 - RNA, 1401 nt, Artificial Sequence; identical to SEQ ID NO: 89676
  derived and/or modified sequence opt1 from neuraminidase__InfluenzaB__AFJ91707

SEQ ID NO: 90071 - RNA, 1401 nt, Artificial Sequence
  derived and/or modified sequence opt1 from neuraminidase__InfluenzaB__AFK09801
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccgaacgacggcuccaucaccgggcccugcgagagcaacggcgaccggggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcccuggcgcucagcggcgucauggugcccauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 90072 - RNA, 1401 nt, Artificial Sequence; identical to SEQ ID NO: 89800
  derived and/or modified sequence opt1 from neuraminidase__InfluenzaB__AFN54669

SEQ ID NO: 90073 - RNA, 1401 nt, Artificial Sequence; identical to SEQ ID NO: 89800
  derived and/or modified sequence opt1 from neuraminidase__InfluenzaB__AFN54680

SEQ ID NO: 90074 - RNA, 1401 nt, Artificial Sequence; identical to SEQ ID NO: 89825
  derived and/or modified sequence opt1 from neuraminidase__InfluenzaB__AFN54691

SEQ ID NO: 90075 - RNA, 1401 nt, Artificial Sequence; identical to SEQ ID NO: 89825
  derived and/or modified sequence opt1 from neuraminidase__InfluenzaB__AFN54702

SEQ ID NO: 90076 - RNA, 1401 nt, Artificial Sequence; identical to SEQ ID NO: 89825
  derived and/or modified sequence opt1 from neuraminidase__InfluenzaB__AFN54713

SEQ ID NO: 90077 - RNA, 1401 nt, Artificial Sequence; identical to SEQ ID NO: 89825
  derived and/or modified sequence opt1 from neuraminidase__InfluenzaB__AFN54724

SEQ ID NO: 90078 - RNA, 1401 nt, Artificial Sequence; identical to SEQ ID NO: 89825
  derived and/or modified sequence opt1 from neuraminidase__InfluenzaB__AFN54735

SEQ ID NO: 90079 - RNA, 1401 nt, Artificial Sequence; identical to SEQ ID NO: 89825
  derived and/or modified sequence opt1 from neuraminidase__InfluenzaB__AFN54746

SEQ ID NO: 90080 - RNA, 1401 nt, Artificial Sequence; identical to SEQ ID NO: 89825
  derived and/or modified sequence opt1 from neuraminidase__InfluenzaB__AFN54757

SEQ ID NO: 90081 - RNA, 1401 nt, Artificial Sequence; identical to SEQ ID NO: 89825
  derived and/or modified sequence opt1 from neuraminidase__InfluenzaB__AFN54768

SEQ ID NO: 90082 - RNA, 1401 nt, Artificial Sequence; identical to SEQ ID NO: 89825
  derived and/or modified sequence opt1 from neuraminidase__InfluenzaB__AFN54779

SEQ ID NO: 90083 - RNA, 1401 nt, Artificial Sequence; identical to SEQ ID NO: 89825
  derived and/or modified sequence opt1 from neuraminidase__InfluenzaB__AFN54790

SEQ ID NO: 90084 - RNA, 1401 nt, Artificial Sequence; identical to SEQ ID NO: 89825
  derived and/or modified sequence opt1 from neuraminidase__InfluenzaB__AFN54801

SEQ ID NO: 90085 - RNA, 1401 nt, Artificial Sequence; identical to SEQ ID NO: 89825
  derived and/or modified sequence opt1 from neuraminidase__InfluenzaB__AFN54812

SEQ ID NO: 90086 - RNA, 1401 nt, Artificial Sequence
  derived and/or modified sequence opt1 from neuraminidase__InfluenzaB__AFN54834
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggaucuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccggggugaacaugacccuguga

SEQ ID NO: 90087 - RNA, 1401 nt, Artificial Sequence; identical to SEQ ID NO: 89825
  derived and/or modified sequence opt1 from neuraminidase__InfluenzaB__AFN54845

SEQ ID NO: 90088 - RNA, 1401 nt, Artificial Sequence
  derived and/or modified sequence opt1 from neuraminidase__InfluenzaB__AFN54856
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcccuggcgcucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgccaccggggugaacaugacgcuguga

SEQ ID NO: 90089 - RNA, 1401 nt, Artificial Sequence; identical to SEQ ID NO: 89825
  derived and/or modified sequence opt1 from neuraminidase__InfluenzaB__AFN54867

SEQ ID NO: 90090 - RNA, 1401 nt, Artificial Sequence
  derived and/or modified sequence opt1 from neuraminidase__InfluenzaB__AFU34598
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucaccuuccuccugcccgagcccgaguggaccuacccgcggcuguccugccccgggagcacguuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucuccgugaagcucggcaagauccccacgguggagaacagcaucuuccacauggccgccugguccgggagcgccugccacgacggcaaggaguggaccuacaucggcgucgacgggccggacaacaacgcccugcugaaggugaaguacggcgaggcguacaccgacaccuaccacuccuacgccaacaagauccuccggacgcgcgagagcgccugcaacugcaucgggggcaacugcuaccugaugaucaccgacggcagcgccuccggggugagcgagugccgguuccugaagauccgcgucggccggaucaucaaggagaucuuccccaccgggcgcgugaagcacaccgaggagugcacgugcggcuucgccuccaacaagaccaucgagugcgcgugccgggacaacagcuacaccgccaagcgccccuucgugaagcucaacgucgagaccgacacggccgagauccggcugaugugcaccgacaccuaccuggacacgccccgcccggacgacggguccaucaccggccccugcgagagcaacggcgacaagggguccggcgggaucaagggcggguucgugcaccagcggauggagagcaagaucggccgcugguacucccggaccaugagcaagaccgagcgcaugggcauggggcucuacgugaaguacgacggcgaccccugggccgacuccgacgcccuggcguucagcggggucaugguguccaugaaggagcccggcugguacagcuucggguucgagaucaaggacaagaagugcgacgugccgugcaucggcaucgagaugguccacgacggcgggaaggagaccuggcacuccgccgccacggccaucuacugccugaugggcagcgggcagcuccugugggacaccgugaccggcguggacgucgcccuguga

SEQ ID NO: 90091 - RNA, 1401 nt, Artificial Sequence
  derived and/or modified sequence opt1 from neuraminidase__InfluenzaB__AFU34609
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccacccggggcgucaccuuccugcugcccgagcccgagugggccuacccgcgccucagcugccccggguccaccuuccagaaggcgcugcugaucagcccccaccgguucggcgagacgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcugaugugcacggacaccuaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcgcuggccuucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 90092 - RNA, 1401 nt, Artificial Sequence
  derived and/or modified sequence opt1 from neuraminidase__InfluenzaB__AFU34620
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccacccggggcgucaccuuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90093 - RNA, 1401 nt, Artificial Sequence
  derived and/or modified sequence opt1 from neuraminidase__InfluenzaB__AFU34631
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccacccggggcgucaccuuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcgcacgcaggaguccgccugcaacugcauccgggggaacugcuaccugaugaucaccgacggcagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacggcagcaucaccgggcccugcgaguccaacggcgacaagggcagcgggggcaucaagggcggguucguccaccagcgcauggaguccaagaucgggcggugguacagccgcaccauguccaagaccgagcggaugggcaugggccuguacgugaaguacgacggggaccccugggccgacagcgacgcccuggcguucuccggcgugauggucagcaugaaggagcccgggugguacuccuucggcuucgagaucaaggacaagaagugcgacgugccgugcaucgggaucgagauggugcacgacggcggcaaggagaccuggcacagcgccgccacggccaucuacugccucaugggguccggccagcugcugugggacaccgucaccgggguggacauggcccucuga

SEQ ID NO: 90094 - RNA, 1401 nt, Artificial Sequence
  derived and/or modified sequence opt1 from neuraminidase__InfluenzaB__AFU34642
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcaugaccuuccuccugcccgagcccgaguggaccuacccgcggcuguccugccccgggagcacguuccagaaggcccuccugaucagcccccaccgcuucggcgagaccaaggggaacuccgcgccccugaucauccgggagccguucaucgccugcggccccaacggcugcaagcacuucgcccucacccacuacgccgcgcagcccgggggcuacuacaacgggacccgcggcgaccggaacaagcugcgccaccugaucuccgucaagcucgggaagauccccacgguggagaacagcaucuuccacauggccgccugguccggcagcgccugccacgacggcaaggaguggaccuacaucgggguggacggcccggacaacaacgcccugcugaaggucaaguacggggaggcguacaccgacaccuaccacuccuacgccaacaagauccuccggacgcaggagagcgccugcaacugcaucggcggcaacugcuaccugaugaucaccgacgggagcgccuccggcgugagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgucaagcucaacguggagaccgacacggccgagauccgccugaugugcaccgacaccuaccuggacacgccccggccggacgacggcuccaucaccggccccugcgagagcuacggggacaagggcuccgggggcaucaagggcggguucgugcaccagcgcauggagagcaagaucggccggugguacucccgcaccaugagcaagaccgagcggauggggaugggccucuacgucaaguacgacggggaccccugggccgacuccgacgcccuggcguucagcggcgugaugguguccaugaaggagcccgggugguacagcuucggcuucgagaucaaggacaagaagugcgacgucccgugcaucggcaucgagauggugcacgacgggggcaaggagaccuggcacuccgccgccacggccaucuacugccugauggggagcggccagcuccugugggacaccgugaccggcgucgacauggcccuguga

SEQ ID NO: 90095 - RNA, 1401 nt, Artificial Sequence
  derived and/or modified sequence opt1 from neuraminidase__InfluenzaB__AGB97261
augcugcccagcaccauccagacccucacgcuguuccugaccuccggcggggugcuccugagccuguacgucuccgccagccucuccuaccugcuguacagcgacaugcuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 90096 - RNA, 1401 nt, Artificial Sequence
  derived and/or modified sequence opt1 from neuraminidase__InfluenzaB__AGB97267
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcaucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcgucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaaccgguacaccgccaagcgccccuucgugaagcugaacgucgagaccgacaccgccgagauccggcugaugugcacggagaccuaccucgacaccccgcgccccaacgacggcuccaucaccgggcccugcgagagcgacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcccuguga

SEQ ID NO: 90097 - RNA, 1401 nt, Artificial Sequence; identical to SEQ ID NO: 89825
  derived and/or modified sequence opt1 from neuraminidase__InfluenzaB__AGR54784

SEQ ID NO: 90098 - RNA, 1401 nt, Artificial Sequence; identical to SEQ ID NO: 89690
  derived and/or modified sequence opt1 from neuraminidase__InfluenzaB__AGX15491

SEQ ID NO: 90099 - RNA, 1401 nt, Artificial Sequence
  derived and/or modified sequence opt1 from neuraminidase__InfluenzaB__AGX15533
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaaggucggccggugguacagccgcacgauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 90100 - RNA, 1401 nt, Artificial Sequence; identical to SEQ ID NO: 89643
  derived and/or modified sequence opt1 from neuraminidase__InfluenzaB__AGX15545

SEQ ID NO: 90101 - RNA, 1401 nt, Artificial Sequence; identical to SEQ ID NO: 89643
  derived and/or modified sequence opt1 from neuraminidase__InfluenzaB__AGX15556

SEQ ID NO: 90102 - RNA, 1401 nt, Artificial Sequence
  derived and/or modified sequence opt1 from neuraminidase__InfluenzaB__AGX15567
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcuggccuucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcgugaacauggcgcucuga

SEQ ID NO: 90103 - RNA, 1401 nt, Artificial Sequence; identical to SEQ ID NO: 89643
  derived and/or modified sequence opt1 from neuraminidase__InfluenzaB__AGX15578

SEQ ID NO: 90104 - RNA, 1401 nt, Artificial Sequence; identical to SEQ ID NO: 89643
  derived and/or modified sequence opt1 from neuraminidase__InfluenzaB__AGX15589

SEQ ID NO: 90105 - RNA, 1401 nt, Artificial Sequence; identical to SEQ ID NO: 89849
  derived and/or modified sequence opt1 from neuraminidase__InfluenzaB__AGX15600

SEQ ID NO: 90106 - RNA, 1401 nt, Artificial Sequence; identical to SEQ ID NO: 89849
  derived and/or modified sequence opt1 from neuraminidase__InfluenzaB__AGX15611

SEQ ID NO: 90107 - RNA, 1401 nt, Artificial Sequence; identical to SEQ ID NO: 89969
  derived and/or modified sequence opt1 from neuraminidase__InfluenzaB__AGX15644

SEQ ID NO: 90108 - RNA, 1401 nt, Artificial Sequence; identical to SEQ ID NO: 89969
  derived and/or modified sequence opt1 from neuraminidase__InfluenzaB__AGX15655

SEQ ID NO: 90109 - RNA, 1401 nt, Artificial Sequence; identical to SEQ ID NO: 89969
  derived and/or modified sequence opt1 from neuraminidase__InfluenzaB__AGX15666

SEQ ID NO: 90110 - RNA, 1401 nt, Artificial Sequence; identical to SEQ ID NO: 89969
  derived and/or modified sequence opt1 from neuraminidase__InfluenzaB__AGX15679

SEQ ID NO: 90111 - RNA, 1401 nt, Artificial Sequence
  derived and/or modified sequence opt1 from neuraminidase__InfluenzaB__AGX15690
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcaugaaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90112 - RNA, 1401 nt, Artificial Sequence; identical to SEQ ID NO: 89969
  derived and/or modified sequence opt1 from neuraminidase__InfluenzaB__AGX15701

SEQ ID NO: 90113 - RNA, 1401 nt, Artificial Sequence
  derived and/or modified sequence opt1 from neuraminidase__InfluenzaB__AGX15712
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagccgaaggggaacuccgcgccccucaucauccgggagcccuucaucgccugcggccccaacgagugcaagcacuucgcccugacccacuacgccgcgcagccgggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggccguucgugaagcugaacguggagaccgacaccgccgagauccgccugaugugcacggacaccuaccucgacacgccccggcccaacgacgggagcaucaccggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgacccgugggccgacagcgacgcccuggcguucuccggggugauggucagcaugaaggagcccggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcgugaacauggcccucuga

SEQ ID NO: 90114 - RNA, 1401 nt, Artificial Sequence; identical to SEQ ID NO: 89969
  derived and/or modified sequence opt1 from neuraminidase__InfluenzaB__AGX15723

SEQ ID NO: 90115 - RNA, 1401 nt, Artificial Sequence; identical to SEQ ID NO: 89969
  derived and/or modified sequence opt1 from neuraminidase__InfluenzaB__AGX15745

SEQ ID NO: 90116 - RNA, 1401 nt, Artificial Sequence; identical to SEQ ID NO: 89969
  derived and/or modified sequence opt1 from neuraminidase__InfluenzaB__AGX15757

SEQ ID NO: 90117 - RNA, 1401 nt, Artificial Sequence
  derived and/or modified sequence opt1 from neuraminidase__InfluenzaB__AGX15768
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugaugaucagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 90118 - RNA, 1401 nt, Artificial Sequence
  derived and/or modified sequence opt1 from neuraminidase__InfluenzaB__AGX15801
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgugaacgcguccaacgugcaggccgucaaccgcagcgccaccaagggcgugacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcccagcccggcggguacuacaacggcacccgcggggaccggaacaagcugcgccaccucaucuccgugaagcugggcaagauccccacggucgagaacagcaucuuccacauggcggccugguccgggagcgccugccacgacggcaaggaguggaccuacaucggcguggacgggccggacaacaacgcccugcucaaggugaaguacggcgaggccuacaccgacaccuaccacuccuacgcgaacaagauccugcggacgcaggagagcgccugcaacugcaucgggggcaacugcuaccugaugaucaccgacggcagcgccuccggggucagcgagugccgcuuccucaagauccgggagggccgcaucaucaaggagaucuuccccaccgggcgggugaagcacaccgaggagugcacgugcggcuucgccuccaacaagaccaucgagugcgccugccgcgacaacagcuacaccgcgaagcggcccuucgugaagcugaacgucgagaccgacacggccgagauccgccugaugugcaccgacaccuaccucgacacgccccggccgaacgacggguccaucaccggccccugcgagagcaacggcgacaagggguccggcgggaucaagggcggguucgugcaccagcgcauggagagcaagaucggccggugguacucccgcaccaugagcaagaccgagcggaugggcauggggcuguacgugaaguacgacggcgaccccugggccgacuccgacgcccuggccuucagcggggucaugguguccaugaaggagcccggcugguacagcuucggguucgagaucaaggacaagaagugcgacgugccgugcaucggcaucgagaugguccacgacggcgggaaggagaccuggcacuccgcggccacggccaucuacugccucaugggcagcgggcagcugcugugggacaccgugaccggcguggacauggcccucuga

SEQ ID NO: 90119 - RNA, 1401 nt, Artificial Sequence; identical to SEQ ID NO: 89969
  derived and/or modified sequence opt1 from neuraminidase__InfluenzaB__AGX15812

SEQ ID NO: 90120 - RNA, 1401 nt, Artificial Sequence; identical to SEQ ID NO: 89969
  derived and/or modified sequence opt1 from neuraminidase__InfluenzaB__AGX15823

SEQ ID NO: 90121 - RNA, 1401 nt, Artificial Sequence; identical to SEQ ID NO: 89903
  derived and/or modified sequence opt1 from neuraminidase__InfluenzaB__AGX15845

SEQ ID NO: 90122 - RNA, 1401 nt, Artificial Sequence; identical to SEQ ID NO: 89880
  derived and/or modified sequence opt1 from neuraminidase__InfluenzaB__AGX15856

SEQ ID NO: 90123 - RNA, 1401 nt, Artificial Sequence; identical to SEQ ID NO: 89903
  derived and/or modified sequence opt1 from neuraminidase__InfluenzaB__AGX15867

SEQ ID NO: 90124 - RNA, 1401 nt, Artificial Sequence; identical to SEQ ID NO: 89903
  derived and/or modified sequence opt1 from neuraminidase__InfluenzaB__AGX15889

SEQ ID NO: 90125 - RNA, 1401 nt, Artificial Sequence
  derived and/or modified sequence opt1 from neuraminidase__InfluenzaB__AGX15900
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacaccagcaacgugcaggccgugaaccgcuccgccaccaagggcgucaccuuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaacgagugcaagcacuucgcccugacccacuacgccgcccagcccggcggguacuacaacggcacgcgcggggaccggaacaagcugcgccaccucaucagcgugaagcugggcaagauccccaccguggagaacuccaucuuccacauggcggccuggagcggguccgccugccacgacggcaaggaguggaccuacaucggcgucgacgggccggacaacgacgcccugcucaaggugaaguacggcgaggccuacaccgacacguaccacagcuacgcgaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacacggaggagugcacgugcggcuucgccagcaacaagaccaucgagugcgccugccgcgacaacuccuacaccgcgaagcggcccuucgugaagcugaacguggagaccgacaccgccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggcgcggcauggggcuguacgugaaguacgacggcgaccccugggccgacagcgacgcccuggccuucuccggggugauggucagcaugaaggagcccggcugguacuccuucggguucgagaucaaggacaagaagugcgacgugccgugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90126 - RNA, 1401 nt, Artificial Sequence; identical to SEQ ID NO: 89903
  derived and/or modified sequence opt1 from neuraminidase__InfluenzaB__AGX15911

SEQ ID NO: 90127 - RNA, 1401 nt, Artificial Sequence
  derived and/or modified sequence opt1 from neuraminidase__InfluenzaB__AGX15933
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucguccaccagcgcauggaguccaagaucggccggugguacagccgcacgauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 90128 - RNA, 1401 nt, Artificial Sequence; identical to SEQ ID NO: 89903
  derived and/or modified sequence opt1 from neuraminidase__InfluenzaB__AGX15944

SEQ ID NO: 90129 - RNA, 1401 nt, Artificial Sequence; identical to SEQ ID NO: 89964
  derived and/or modified sequence opt1 from neuraminidase__InfluenzaB__AGX15966

SEQ ID NO: 90130 - RNA, 1401 nt, Artificial Sequence
  derived and/or modified sequence opt1 from neuraminidase__InfluenzaB__AGX15988
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagguccgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccugaccuucuccggggucauggugagcaugaaggagccgggcugguacuccuucggguucgagaucaaggacaagaagugcgacgugcccugcaucggcaucgagaugguccacgacggcgggaaggagacguggcacagcgcggccaccgccaucuacugccucaugggcuccgggcagcugcugugggacaccgugaccggcguggacauggcccucuga

SEQ ID NO: 90131 - RNA, 1401 nt, Artificial Sequence; identical to SEQ ID NO: 89964
  derived and/or modified sequence opt1 from neuraminidase__InfluenzaB__AGX15999

SEQ ID NO: 90132 - RNA, 1401 nt, Artificial Sequence; identical to SEQ ID NO: 89964
  derived and/or modified sequence opt1 from neuraminidase__InfluenzaB__AGX16010

SEQ ID NO: 90133 - RNA, 1401 nt, Artificial Sequence; identical to SEQ ID NO: 89964
  derived and/or modified sequence opt1 from neuraminidase__InfluenzaB__AGX16021

SEQ ID NO: 90134 - RNA, 1401 nt, Artificial Sequence
  derived and/or modified sequence opt1 from neuraminidase__InfluenzaB__AGX16032
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 90135 - RNA, 1401 nt, Artificial Sequence; identical to SEQ ID NO: 89751
  derived and/or modified sequence opt1 from neuraminidase__InfluenzaB__AGX16043

SEQ ID NO: 90136 - RNA, 1401 nt, Artificial Sequence; identical to SEQ ID NO: 89753
  derived and/or modified sequence opt1 from neuraminidase__InfluenzaB__AGX16054

SEQ ID NO: 90137 - RNA, 1401 nt, Artificial Sequence
  derived and/or modified sequence opt1 from neuraminidase__InfluenzaB__AGX16087
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacaacuacaccgccaagcgccccuucgugaagcugaacgucgagaccgacaccgccgagauccggcugaugugcacggagaccuaccucgacaccccgcgccccaacgacggcuccaucaccgggcccugcgagagcaacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcccuguga

SEQ ID NO: 90138 - RNA, 1401 nt, Artificial Sequence
  derived and/or modified sequence opt1 from neuraminidase__InfluenzaB__AGX16109
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacgucggcguggacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcuggacguggagaccgacacggccgagauccggcugaugugcaccgagaccuaccucgacaccccgcgccccaacgacggcagcaucacggggcccugcgaggccaacggcgacaagggcuccgggggcaucaagggcggguucgugcaccagcggauggccagcaagaucgggcgcugguacucccggaccaugagcaagaccaagcgcaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagacgaccuggcacuccgccgccaccgccaucuacugccugauggggagcggccagcugcucugggacaccgugacgggggucgacauggcgcuguga

SEQ ID NO: 90139 - RNA, 1401 nt, Artificial Sequence
  derived and/or modified sequence opt1 from neuraminidase__InfluenzaB__AGX16120
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucaccuuccuccugcccgagcccgaguggacguacccgcggcugagcugccccggguccaccuuccagaaggcccuccugaucagcccccaccgcuucggcgagaccaaggggaacuccgcgccccugaucauccgggagccguucaucgccugcggccccaaggagugcaagcacuucgcccucacccacuacgccgcgcagcccggcggguacuacaacggcacgcgcgaggaccggaacaagcugcgccaccugaucagcgugaagcucgggaagauccccaccguggagaacuccaucuuccacauggccgccuggagcggcuccgccugccacgacgggaaggaguggaccuacaucggcgucgacggcccggacagcaacgcccugcugaagaucaaguacggggaggcguacaccgacacguaccacuccuacgccaacaacauccuccggacccaggagagcgccugcaacugcaucggcgggaacugcuaccugaugaucaccgacggcagcgccuccggcaucagcgagugccgcuuccugaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcucaacgucgagaccgacaccgccgagauccgccugaugugcaccgagaccuaccuggacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccucuacgugaaguacgacggggaccccuggacggacuccgacgcccuggcgcugagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccucauggggagcggccagcugcugugggacaccgugacggggguggacauggcccucuga

SEQ ID NO: 90140 - RNA, 1401 nt, Artificial Sequence; identical to SEQ ID NO: 90139
  derived and/or modified sequence opt1 from neuraminidase__InfluenzaB__AGX16131

SEQ ID NO: 90141 - RNA, 1401 nt, Artificial Sequence; identical to SEQ ID NO: 90139
  derived and/or modified sequence opt1 from neuraminidase__InfluenzaB__AGX16142

SEQ ID NO: 90142 - RNA, 1401 nt, Artificial Sequence
  derived and/or modified sequence opt1 from neuraminidase__InfluenzaB__AGX16153
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgcggggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacaugacggccuggagcggcuccgccugccacgacgggcgcgaguggaccuacaucggcgucgacggcccggacagcaacgcccugcucaagaucaaguacggggaggccuacaccgacaccuaccacuccuacgcgaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggcccuucgugaagcugaacgucgagaccgacacggccgagauccgccugaugugcaccgagaccuaccucgacaccccgcggcccaacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagacgaccuggcacagcgcggccaccgccaucuacugccugaugggguccggccagcugcucugggacaccgugacggggguggacauggcccuguga

SEQ ID NO: 90143 - RNA, 1401 nt, Artificial Sequence; identical to SEQ ID NO: 90137
  derived and/or modified sequence opt1 from neuraminidase__InfluenzaB__AGX16164

SEQ ID NO: 90144 - RNA, 1401 nt, Artificial Sequence; identical to SEQ ID NO: 89796
  derived and/or modified sequence opt1 from neuraminidase__InfluenzaB__AGX16197

SEQ ID NO: 90145 - RNA, 1401 nt, Artificial Sequence; identical to SEQ ID NO: 89796
  derived and/or modified sequence opt1 from neuraminidase__InfluenzaB__AGX16208

SEQ ID NO: 90146 - RNA, 1401 nt, Artificial Sequence; identical to SEQ ID NO: 89796
  derived and/or modified sequence opt1 from neuraminidase__InfluenzaB__AGX16219

SEQ ID NO: 90147 - RNA, 1401 nt, Artificial Sequence; identical to SEQ ID NO: 89635
  derived and/or modified sequence opt1 from neuraminidase__InfluenzaB__AGX16230

SEQ ID NO: 90148 - RNA, 1401 nt, Artificial Sequence
  derived and/or modified sequence opt1 from neuraminidase__InfluenzaB__AGX16241
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaucgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccugacccucuccggcgucauggugagcauggaggagccggggugguacuccuucggcuucgagaucaaggacaagaagugcgacgugcccugcaucgggaucgagaugguccacgacggcggcaagaccacguggcacagcgcggccaccgccaucuacugccugaugggguccggccagcugcucugggacaccgugaccgggguggacauggcccuguga

SEQ ID NO: 90149 - RNA, 1401 nt, Artificial Sequence
  derived and/or modified sequence opt1 from neuraminidase__InfluenzaB__AGX16252
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgagugggcguacccgcggcucagcugccccggguccaccuuccagaaggcccugcugaucagcccccaccgcuucggcgagaccaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgcgugccacgacgggaaggaguggaccuacaucggcgucgacggcccggacagcaacgcccugcucaagaucaaguacggggaggccuacacggacaccuaccacuccuacgccaagaacauccugcggacccaggagagcgccugcaacugcaucggcggggacugcuaccugaugaucaccgacggccccgcgagcggcaucuccgagugccgcuuccucaagauccgggaggggcgcaucaucaaggagaucuuccccacgggccgggugaagcacaccgaggagugcacgugcggguucgccagcaacaagaccaucgagugcgccugccgcgacaaccgguacaccgccaagcgccccuucgugaagcugaacgucgagaccgacaccgccgagauccggcugaugugcaccgagacguaccucgacaccccgcgccccaacgacggcuccaucaccgggcccugcgagagcgacggcgacaagggcuccgggggcaucaagggcggguucgugcaccagcggauggcgagcaagaucgggcgcugguacucccggaccaugagcaagacgaagcgcaugggcaugggccuguacgugaaguacgacggggaccccuggaccgacuccgaggcccuggcccucagcggcgucaugguguccauggaggagccggggugguacagcuucggcuucgagaucaaggacaagaagugcgacgugcccugcaucgggaucgagaugguccacgacggcggcaagaccaccuggcacuccgccgccacggcgaucuacugccugauggggagcggccagcugcucugggacaccgugaccgggguggacauggcccuguga

SEQ ID NO: 90150 - RNA, 1401 nt, Artificial Sequence; identical to SEQ ID NO: 89796
  derived and/or modified sequence opt1 from neuraminidase__InfluenzaB__AGX16274

SEQ ID NO: 90151 - RNA, 1401 nt, Artificial Sequence
  derived and/or modified sequence opt1 from neuraminidase__InfluenzaB__AGX16285
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaccacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcgcuguga

SEQ ID NO: 90152 - RNA, 1401 nt, Artificial Sequence; identical to SEQ ID NO: 89796
  derived and/or modified sequence opt1 from neuraminidase__InfluenzaB__AGX16296

SEQ ID NO: 90153 - RNA, 1401 nt, Artificial Sequence; identical to SEQ ID NO: 89643
  derived and/or modified sequence opt1 from neuraminidase__InfluenzaB__AGX16307

SEQ ID NO: 90154 - RNA, 1401 nt, Artificial Sequence; identical to SEQ ID NO: 89796
  derived and/or modified sequence opt1 from neuraminidase__InfluenzaB__AGX16329

SEQ ID NO: 90155 - RNA, 1401 nt, Artificial Sequence
  derived and/or modified sequence opt1 from neuraminidase__InfluenzaB__AGX16362
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 90156 - RNA, 1401 nt, Artificial Sequence; identical to SEQ ID NO: 89968
  derived and/or modified sequence opt1 from neuraminidase__InfluenzaB__AGX16373

SEQ ID NO: 90157 - RNA, 1401 nt, Artificial Sequence
  derived and/or modified sequence opt1 from neuraminidase__InfluenzaB__AGX16384
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugaagcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90158 - RNA, 1401 nt, Artificial Sequence; identical to SEQ ID NO: 89825
  derived and/or modified sequence opt1 from neuraminidase__InfluenzaB__AGX16406

SEQ ID NO: 90159 - RNA, 1401 nt, Artificial Sequence; identical to SEQ ID NO: 89825
  derived and/or modified sequence opt1 from neuraminidase__InfluenzaB__AGX16427

SEQ ID NO: 90160 - RNA, 1401 nt, Artificial Sequence; identical to SEQ ID NO: 89825
  derived and/or modified sequence opt1 from neuraminidase__InfluenzaB__AGX16438

SEQ ID NO: 90161 - RNA, 1401 nt, Artificial Sequence; identical to SEQ ID NO: 89825
  derived and/or modified sequence opt1 from neuraminidase__InfluenzaB__AGX16449

SEQ ID NO: 90162 - RNA, 1401 nt, Artificial Sequence; identical to SEQ ID NO: 89825
  derived and/or modified sequence opt1 from neuraminidase__InfluenzaB__AGX16460

SEQ ID NO: 90163 - RNA, 1401 nt, Artificial Sequence
  derived and/or modified sequence opt1 from neuraminidase__InfluenzaB__AGX16471
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacgaagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagacccggcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90164 - RNA, 1401 nt, Artificial Sequence; identical to SEQ ID NO: 89825
  derived and/or modified sequence opt1 from neuraminidase__InfluenzaB__AGX16482

SEQ ID NO: 90165 - RNA, 1401 nt, Artificial Sequence
  derived and/or modified sequence opt1 from neuraminidase__InfluenzaB__AGX16493
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucguggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 90166 - RNA, 1401 nt, Artificial Sequence; identical to SEQ ID NO: 89624
  derived and/or modified sequence opt1 from neuraminidase__InfluenzaB__AGX16504

SEQ ID NO: 90167 - RNA, 1401 nt, Artificial Sequence; identical to SEQ ID NO: 89624
  derived and/or modified sequence opt1 from neuraminidase__InfluenzaB__AGX16515

SEQ ID NO: 90168 - RNA, 1401 nt, Artificial Sequence
  derived and/or modified sequence opt1 from neuraminidase__InfluenzaB__AGX16548
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaacgggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcugcucugggacaccgugaccggcguggacauggcgcuguga

SEQ ID NO: 90169 - RNA, 1401 nt, Artificial Sequence
  derived and/or modified sequence opt1 from neuraminidase__InfluenzaB__AGX16559
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagauccgcgacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90170 - RNA, 1401 nt, Artificial Sequence
  derived and/or modified sequence opt1 from neuraminidase__InfluenzaB__AGX16581
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90171 - RNA, 1401 nt, Artificial Sequence; identical to SEQ ID NO: 90170
  derived and/or modified sequence opt1 from neuraminidase__InfluenzaB__AGX16592

SEQ ID NO: 90172 - RNA, 1401 nt, Artificial Sequence; identical to SEQ ID NO: 89624
  derived and/or modified sequence opt1 from neuraminidase__InfluenzaB__AGX16603

SEQ ID NO: 90173 - RNA, 1401 nt, Artificial Sequence; identical to SEQ ID NO: 89690
  derived and/or modified sequence opt1 from neuraminidase__InfluenzaB__AGX16614

SEQ ID NO: 90174 - RNA, 1401 nt, Artificial Sequence; identical to SEQ ID NO: 90168
  derived and/or modified sequence opt1 from neuraminidase__InfluenzaB__AGX16625

SEQ ID NO: 90175 - RNA, 1401 nt, Artificial Sequence
  derived and/or modified sequence opt1 from neuraminidase__InfluenzaB__AGX16636
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucuggaacacggugaccggcguggacauggcgcuguga

SEQ ID NO: 90176 - RNA, 1401 nt, Artificial Sequence; identical to SEQ ID NO: 89622
  derived and/or modified sequence opt1 from neuraminidase__InfluenzaB__AGX16647

SEQ ID NO: 90177 - RNA, 1401 nt, Artificial Sequence; identical to SEQ ID NO: 90170
  derived and/or modified sequence opt1 from neuraminidase__InfluenzaB__AGX16658

SEQ ID NO: 90178 - RNA, 1401 nt, Artificial Sequence; identical to SEQ ID NO: 89624
  derived and/or modified sequence opt1 from neuraminidase__InfluenzaB__AGX16669

SEQ ID NO: 90179 - RNA, 1401 nt, Artificial Sequence; identical to SEQ ID NO: 89690
  derived and/or modified sequence opt1 from neuraminidase__InfluenzaB__AGX16680

SEQ ID NO: 90180 - RNA, 1401 nt, Artificial Sequence; identical to SEQ ID NO: 89624
  derived and/or modified sequence opt1 from neuraminidase__InfluenzaB__AGX16691

SEQ ID NO: 90181 - RNA, 1401 nt, Artificial Sequence
  derived and/or modified sequence opt1 from neuraminidase__InfluenzaB__AGX16702
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90182 - RNA, 1401 nt, Artificial Sequence
  derived and/or modified sequence opt1 from neuraminidase__InfluenzaB__AGX16713
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccaucuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagauccgcgacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90183 - RNA, 1401 nt, Artificial Sequence; identical to SEQ ID NO: 89624
  derived and/or modified sequence opt1 from neuraminidase__InfluenzaB__AGX16724

SEQ ID NO: 90184 - RNA, 1401 nt, Artificial Sequence; identical to SEQ ID NO: 90170
  derived and/or modified sequence opt1 from neuraminidase__InfluenzaB__AGX16735

SEQ ID NO: 90185 - RNA, 1401 nt, Artificial Sequence; identical to SEQ ID NO: 90170
  derived and/or modified sequence opt1 from neuraminidase__InfluenzaB__AGX16746

SEQ ID NO: 90186 - RNA, 1401 nt, Artificial Sequence; identical to SEQ ID NO: 89624
  derived and/or modified sequence opt1 from neuraminidase__InfluenzaB__AGX16757

SEQ ID NO: 90187 - RNA, 1401 nt, Artificial Sequence
  derived and/or modified sequence opt1 from neuraminidase__InfluenzaB__AGX16768
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcaaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90188 - RNA, 1401 nt, Artificial Sequence; identical to SEQ ID NO: 89690
  derived and/or modified sequence opt1 from neuraminidase__InfluenzaB__AGX16779

SEQ ID NO: 90189 - RNA, 1401 nt, Artificial Sequence
  derived and/or modified sequence opt1 from neuraminidase__InfluenzaB__AGX16790
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgggggccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaagaucaaguacggggaggcguacaccgacaccuaccacagcuacgccaacaacauccugcggacgcaggaguccgccugcaacugcaucggcggcaacugcuaccugaugaucaccgacgggagcgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacggcagcaucacgggccccugcgaguccaacggggacaagggcagcgggggcaucaagggcggguucgugcaccagcgcauggccuccaagaucggccggugguacagccgcaccauguccaagaccaagcggauggggaugggccuguacgugaaguacgacggggaccccugggccgacagcgacgcgcuggcccucuccggcgucauggugagcauggaggagccggggugguacuccuucggcuucgagauccgcgacaagaagugcgacgugcccugcaucggcaucgagaugguccacgacgggggcaaggagaccuggcacagcgccgccacggccaucuacugccugaugggguccggccagcugcucugggacaccgugaccggcguggacauggcgcuguga

SEQ ID NO: 90190 - RNA, 1401 nt, Artificial Sequence
  derived and/or modified sequence opt1 from neuraminidase__InfluenzaB__AGX16801
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90191 - RNA, 1401 nt, Artificial Sequence; identical to SEQ ID NO: 89624
  derived and/or modified sequence opt1 from neuraminidase__InfluenzaB__AGX16812

SEQ ID NO: 90192 - RNA, 1401 nt, Artificial Sequence
  derived and/or modified sequence opt1 from neuraminidase__InfluenzaB__AGX16823
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgccgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggcggacagcgacgcccuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccacggcgaucuacugccugaugggcuccgggcagcugcucugggacaccgugaccggcguggacauggcccuguga

SEQ ID NO: 90193 - RNA, 1401 nt, Artificial Sequence; identical to SEQ ID NO: 89624
  derived and/or modified sequence opt1 from neuraminidase__InfluenzaB__AGX16834

SEQ ID NO: 90194 - RNA, 1401 nt, Artificial Sequence
  derived and/or modified sequence opt1 from neuraminidase__InfluenzaB__AGX16845
augcugcccagcaccauccagacccucacgcuguuccugaccuccggcggggugcuccugagccuguacgucuccgccagccucuccuaccugcuguacagcgacauccuccugaaguucuccccgaccgagaucaccacgcccaccaugccccuggacugcgccaacgcgagcaacgugcaggccgugaaccgcuccgccaccaagggcgucacccuccugcugcccgagccggaguggacguacccccggcucagcugccccggguccaccuuccagaaggcccugcuggugagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacgcgcggggaccggaacaagcugcgccaccucaucagcgugaagcugggcaagaucccgaccgucgagaacuccaucuuccacauggcggccuggagcggguccgccugccacgacggcaaggaguggaccuacaucggcguggacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacguggagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcccuggcgcucuccggggugauggugagcauggaggagccgggcugguacuccuucggguucgagaucaaggacaagaagugcgacguccccugcaucggcaucgagauggugcacgacggcgggaaggagacguggcacagcgccgccaccgccaucuacugccugaugggcuccgggcagcugcucugggacaccgugaccggcgucgacauggcccuguga

SEQ ID NO: 90195 - RNA, 1401 nt, Artificial Sequence
  derived and/or modified sequence opt1 from neuraminidase__InfluenzaB__AGX16856
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacggugccccuggacugcgcgaacgccagcaacgugcaggccgucaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacagcggcacccgcggggaccggaacaagcugcgccaccucaucuccgugaagcugggcaagaucccgacggucgagaacagcaucuuccacauggccgccugguccgggagcgccugccacgacggcaaggaguggaccuacaucggcguggacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaacaagcggaugggcauggggcuguacgucaaguacgacggcgaccccugggccgacuccgacgcgcuggcccucagcggggugaugguguccauggaggagccgggcugguacagcuucggguucgagaucaaggacaagaagugcgacguccccugcaucggcaucgagauggugcacgacggcgggaaggagaccuggcacuccgccgccaccgccaucuacugccugaugggcagcgggcagcugcucugggacacggugaccggcgucgacauggcgcuguga

SEQ ID NO: 90196 - RNA, 1401 nt, Artificial Sequence; identical to SEQ ID NO: 89624
  derived and/or modified sequence opt1 from neuraminidase__InfluenzaB__AGX16867

SEQ ID NO: 90197 - RNA, 1401 nt, Artificial Sequence
  derived and/or modified sequence opt1 from neuraminidase__InfluenzaB__AGX16878
augcugcccagcaccauccagacccucacgcuguuccugaccuccggcggggugcuccugagccuguacgucuccgccagccucuccuaccugcuguacagcgacauccuccugaaguucuccccgaccgagcugaccgcccccacgaugccccucgacugcgcgaacgccagcaacgugcaggccgugaaccgcuccgccaccaagggcgucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcaagcgcggggaccggaacaagcuccgccaccugaucagcgugaagcugggcaagaucccgaccguggagaacuccaucuuccacauggccgccuggagcggguccgccugccacgacggcaaggaguggacguacaucggcgucgacgggcccgacaacaacgcccuccugaagaucaaguacggcgaggcguacaccgacaccuaccacagcuacgccaacaacauccugcggacccaggaguccgccugcaacugcaucgggggcaacugcuaccucaugaucacggacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccucaugugcacggagaccuaccuggacaccccgcggcccgacgacgggagcaucaccggccccugcgaguccaacggcgacaacgggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcucgcccuguccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcuccugugggacacggugaccggcguggacauggcgcuguga

SEQ ID NO: 90198 - RNA, 1401 nt, Artificial Sequence; identical to SEQ ID NO: 90170
  derived and/or modified sequence opt1 from neuraminidase__InfluenzaB__AGX16889

SEQ ID NO: 90199 - RNA, 1401 nt, Artificial Sequence
  derived and/or modified sequence opt1 from neuraminidase__InfluenzaB__AGX16900
augcugcccagcaccauccagacccucacgcuguuccugaccaccggcggggugcuccugucccuguacgucagcgccucccucagcuaccugcuguacuccgacauccuccugaaguucagcccgaccgagaucaucgcccccacgaugccccuggacugcgcgaacgccuccaacgugcaggccgugaaccgcagcgccaccaagggcgucacccuccugcugcccgagccggaguggaccuacccccggcucuccugccccgggagcacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcugcucugggacaccgugaccggcguggacauggcgcuguga

SEQ ID NO: 90200 - RNA, 1401 nt, Artificial Sequence
  derived and/or modified sequence opt1 from neuraminidase__InfluenzaB__AGX16911
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugccccucgacugcgcgaacgccuccaacgugcaggccgugaaccgcagcgccaccaagggcgucacccugcugcuccccgagccggaguggaccuacccccggcuguccugccccgggagcacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucuccgugaagcugggcaagaucccgacgguggagaacagcaucuuccacauggccgccugguccgggagcgccugccacgacggcaaggaguggaccuacaucggcgucgacgggcccgacaacaacgcccuccugaagaucaaguacggcgaggcguacaccgacaccuaccacuccuacgccaacaacauccugcggacgcaggagagcgccugcaacugcaucgggggcaacugcuaccucaugaucaccgacggcuccgccagcgggaucagcgagugccgcuuccugaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccucaugugcaccgagaccuaccuggacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcucgcccugagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcuccugugggacaccgugaccggcguggacauggcgcuguga

SEQ ID NO: 90201 - RNA, 1401 nt, Artificial Sequence
  derived and/or modified sequence opt1 from neuraminidase__InfluenzaB__AGX16922
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgaccccugggccgacagcgacgcgcuggcccuguccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcgcucuga

SEQ ID NO: 90202 - RNA, 1401 nt, Artificial Sequence
  derived and/or modified sequence opt1 from neuraminidase__InfluenzaB__AGX16933
augcugcccagcaccauccagacccucacgcuguuccugaccuccggcggggugcuccugagccuguacgucuccgccagccucuccuaccugcuguacagcgacauccuccugaaguucuccccgaccgagaucaacgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcuccuggacacggugaccggcguggacauggcgcuguga

SEQ ID NO: 90203 - RNA, 1401 nt, Artificial Sequence
  derived and/or modified sequence opt1 from neuraminidase__InfluenzaB__AGX16944
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacagcggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaacaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccaccgccaucuacugccugaugggcagcgggcagcugcucugggacacggugaccggcguggacauggcgcuguga

SEQ ID NO: 90204 - RNA, 1401 nt, Artificial Sequence; identical to SEQ ID NO: 89624
  derived and/or modified sequence opt1 from neuraminidase__InfluenzaB__AGX16955

SEQ ID NO: 90205 - RNA, 1401 nt, Artificial Sequence; identical to SEQ ID NO: 89622
  derived and/or modified sequence opt1 from neuraminidase__InfluenzaB__AGX16966

SEQ ID NO: 90206 - RNA, 1401 nt, Artificial Sequence; identical to SEQ ID NO: 89624
  derived and/or modified sequence opt1 from neuraminidase__InfluenzaB__AGX16977

SEQ ID NO: 90207 - RNA, 1401 nt, Artificial Sequence; identical to SEQ ID NO: 89624
  derived and/or modified sequence opt1 from neuraminidase__InfluenzaB__AGX16988

SEQ ID NO: 90208 - RNA, 1401 nt, Artificial Sequence; identical to SEQ ID NO: 90168
  derived and/or modified sequence opt1 from neuraminidase__InfluenzaB__AGX16999

SEQ ID NO: 90209 - RNA, 1401 nt, Artificial Sequence; identical to SEQ ID NO: 89624
  derived and/or modified sequence opt1 from neuraminidase__InfluenzaB__AGX17010

SEQ ID NO: 90210 - RNA, 1401 nt, Artificial Sequence; identical to SEQ ID NO: 90170
  derived and/or modified sequence opt1 from neuraminidase__InfluenzaB__AGX17021

SEQ ID NO: 90211 - RNA, 1401 nt, Artificial Sequence
  derived and/or modified sequence opt1 from neuraminidase__InfluenzaB__AGX17032
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcgacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaaccgcacccggggcgaccgcaacaagcugcggcaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcgcacgcaggaguccgccugcaacugcaucggcgggaacugcuaccugaugaucaccgacggcagcgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccgacgacggcagcaucacggggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggaccccugggccgacagcgacgcgcuggcccucuccggcgucauggugagcauggaggagccggggugguacuccuucggcuucgagaucaaggacaagaagugcgacgugcccugcaucgggaucgagaugguccacgacggcggcaaggagaccuggcacagcgccgccacggccaucuacugccugaugggguccggccagcugcucugggacaccgugaccgggguggacauggcgcuguga

SEQ ID NO: 90212 - RNA, 1401 nt, Artificial Sequence; identical to SEQ ID NO: 89622
  derived and/or modified sequence opt1 from neuraminidase__InfluenzaB__AGX17043

SEQ ID NO: 90213 - RNA, 1401 nt, Artificial Sequence
  derived and/or modified sequence opt1 from neuraminidase__InfluenzaB__AGX17054
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaacgggaacggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcugcucugggacaccgugaccggcguggacauggcgcuguga

SEQ ID NO: 90214 - RNA, 1401 nt, Artificial Sequence
  derived and/or modified sequence opt1 from neuraminidase__InfluenzaB__AGX17065
augcugcccagcaccauccagacccucacgcuguuccugaccuccggcggggugcuccugagccuguacgucuccgcccuccugagcuaccugcucuacuccgacauccugcugaaguucagcccgaccaagaucaucgcccccaccacgucccucgacagcgcgaacgccuccaacuuccaggccgugaaccacagcgccaccaaggagaugaccuuccugcugcccgagcccgaguggaccuacccgcgccucuccugccagggcagcacguuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacccgggaggaccgcaacaagcugcggcaccucaucuccgugaaccugggcaagauccccaccgucgagaacagcaucuuccacauggccgccugguccgggagcgccugccacgacggccgcgaguggacguacaucgggguggacggccccgacuccaacgcgcugaucaagaucaaguacggcgaggccuacaccgacaccuaccacagcuacgccaacaacauccuccggacccaggagagcgccugcaacugcaucgggggcgacugcuaccugaugaucacggacggguccgccagcggcaucuccaagugccgcuuccugaagauccgggagggccgcaucaucaaggagaucuucccgaccgggcggguggagcacaccgaggagugcacgugcggcuucgcgagcaacaagaccaucgagugcgccugccgcgacaacuccuacaccgccaagcggcccuucgucaagcucaacguggagaccgacaccgccgagauccgccugaugugcacggagaccuaccuggacacgccccggcccgacgacgggagcaucaccggcccgugcgaguccaacggggacaagggcagcggcgggaucaagggcggguucgugcaccagcgcauggccuccaagaucggccggugguacagccgcaccaucuccaagaccaagcggauggggauggagcucuacgucaaguacgacggcgaccccuggaccgacagcgacgcgcuggcccccuccggcgugauggugagcaucgaggagcccgggugguacuccuucggcuucgagaucaaggacaagaagugcgacgucccgugcaucgggaucgagauggugcacgacggcgggaagaccacguggcacagcgccgccaccgccaucuacugccugaugggcuccggccagcuccugugggacaccgugaccggggucgacauggcgcuguga

SEQ ID NO: 90215 - RNA, 1401 nt, Artificial Sequence
  derived and/or modified sequence opt1 from neuraminidase__InfluenzaB__AGX17076
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagauccgcgacaagaagugcgacgugcccugcaucggcaucgagaucguccacgacggcgggaaggagaccuggcacagcgccgccacggccaucuacugccugaugggcuccgggcagcugcucugggacaccgugaccggcguggacauggcgcuguga

SEQ ID NO: 90216 - RNA, 1401 nt, Artificial Sequence; identical to SEQ ID NO: 90170
  derived and/or modified sequence opt1 from neuraminidase__InfluenzaB__AGX17087

SEQ ID NO: 90217 - RNA, 1401 nt, Artificial Sequence; identical to SEQ ID NO: 90170
  derived and/or modified sequence opt1 from neuraminidase__InfluenzaB__AGX17098

SEQ ID NO: 90218 - RNA, 1401 nt, Artificial Sequence; identical to SEQ ID NO: 90170
  derived and/or modified sequence opt1 from neuraminidase__InfluenzaB__AGX17109

SEQ ID NO: 90219 - RNA, 1401 nt, Artificial Sequence; identical to SEQ ID NO: 90170
  derived and/or modified sequence opt1 from neuraminidase__InfluenzaB__AGX17120

SEQ ID NO: 90220 - RNA, 1401 nt, Artificial Sequence; identical to SEQ ID NO: 89622
  derived and/or modified sequence opt1 from neuraminidase__InfluenzaB__AGX17131

SEQ ID NO: 90221 - RNA, 1401 nt, Artificial Sequence; identical to SEQ ID NO: 89624
  derived and/or modified sequence opt1 from neuraminidase__InfluenzaB__AGX17142

SEQ ID NO: 90222 - RNA, 1401 nt, Artificial Sequence
  derived and/or modified sequence opt1 from neuraminidase__InfluenzaB__AGX17153
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucaucggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90223 - RNA, 1401 nt, Artificial Sequence; identical to SEQ ID NO: 90170
  derived and/or modified sequence opt1 from neuraminidase__InfluenzaB__AGX17164

SEQ ID NO: 90224 - RNA, 1404 nt, Artificial Sequence
  derived and/or modified sequence opt1 from neuraminidase__InfluenzaB__AGX17175
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaacauccugcggacgcaggaguccgccugcaacugcaucgggggcaacugcuaccucaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccucaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcucgcccuguccggggucauggugagcauggaggagccgggcugguacuccuucggguucgagauccgcgacaagaagugcgacgugcccugcaucggcaucgagaugguccacgacggcgggaaggagaccuggcacagcgccgccacggccaucuacugccugaugggcuccgggcagcuccugugggacaccgugaccggcguggacauggcgcuguga

SEQ ID NO: 90225 - RNA, 1401 nt, Artificial Sequence
  derived and/or modified sequence opt1 from neuraminidase__InfluenzaB__AGX17186
augcugcccagcaccauccagacccucacgcuguuccugaccuccggcggggugcuccugagccuguacgucuccgccagccucuccuaccugcuguacagcgacauccuccugaaguucuccccgaccgagaucaccacgcccaccaugccccuggacugcgccaacgcgagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaaguacacggaggagugcacgugcggcuucgccagcaacaagaccaucgagugcgccugccgcgacaacuccuacaccgcgaagcggcccuucgugaagcugaacgucgagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagacccggcgcaugggcauggggcuguacgugaaguacgacggcgaccccugggccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 90226 - RNA, 1401 nt, Artificial Sequence; identical to SEQ ID NO: 90201
  derived and/or modified sequence opt1 from neuraminidase__InfluenzaB__AGX17197

SEQ ID NO: 90227 - RNA, 1401 nt, Artificial Sequence
  derived and/or modified sequence opt1 from neuraminidase__InfluenzaB__AGX17208
augcugcccagcaccauccagacccucacgcuguuccugaccuccggcggggugcuccugagccuguacgucuccgccagccucuccuaccugcuguacagcgacauccuccugaaguucuccccgaccgagaucaccacgcccaccaugccccuggacugcgccaacgcgagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgugaagcugaacgucgagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagacccggcgcaugggcauggggcuguacgugaaguacgacggcgaccccugggccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 90228 - RNA, 1401 nt, Artificial Sequence; identical to SEQ ID NO: 90170
  derived and/or modified sequence opt1 from neuraminidase__InfluenzaB__AGX17219

SEQ ID NO: 90229 - RNA, 1401 nt, Artificial Sequence; identical to SEQ ID NO: 89624
  derived and/or modified sequence opt1 from neuraminidase__InfluenzaB__AGX17230

SEQ ID NO: 90230 - RNA, 1401 nt, Artificial Sequence; identical to SEQ ID NO: 90170
  derived and/or modified sequence opt1 from neuraminidase__InfluenzaB__AGX17241

SEQ ID NO: 90231 - RNA, 1401 nt, Artificial Sequence
  derived and/or modified sequence opt1 from neuraminidase__InfluenzaB__AGX17252
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagcucgaguggaccuacccgcggcugagcugccccggguccacguuccagaaggcccugcucaucagcccccaccgcuucggcgagaccaaggggaacuccgcgccccugaucauccgggagccguucaucgccugcggccccaaggagugcaagcacuucgcccugaccuacuacgccgcgcagcccggcggguacuacaacggcacccgcggggaccggaacaagcuccgccaccugaucagcgugaagcugggcaagauccccacgguggagaacuccaucuuccacauggccgccuggagcggguccgccugccacgacggcaaggaguggaccuacaucggcgucgacgggccggacaacaacgcccuccugaagaucaaguacggcgaggcguacaccgacaccuaccacagcuacgccaacaacauccugcggacgcaggaguccgccugcaacugcaucgggggcaacugcuaccucaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccucaugugcaccgagaccuaccuggacacgccccggccggccgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggcggacagcgacgcccucgcccuguccggggucauggugagcauggaggagcccggcugguacuccuucggguucgagaucaaggacaagaagugcgacgugccgugcaucggcaucgagaugguccacgacggcgggaaggagaccuggcacagcgccgccacggcgaucuacugccugaugggcuccgggcagcuccugugggacaccgugaccggcguggacauggcccuguga

SEQ ID NO: 90232 - RNA, 1401 nt, Artificial Sequence
  derived and/or modified sequence opt1 from neuraminidase__InfluenzaB__AGX17263
augcugcccagcaccauccagacccucacgcuguuccugaccuccggcggggugcuccugagccuguacgucuccgccagccucuccuaccugcuguacagcgacauccuccugaagcuguccccgaccgagaucaccgcccccacgaugccccucgacugcgcgaacgccagcaacgugcaggccgugaaccgcuccgccaccaagggcgucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaacauccugcggacgcaggaguccgccugcaacugcaucgggggcaacugcuaccucaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccucaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcucgcccuguccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcuccugugggacaccgugaccggcguggacauggcgcuguga

SEQ ID NO: 90233 - RNA, 1401 nt, Artificial Sequence
  derived and/or modified sequence opt1 from neuraminidase__InfluenzaB__AGX17274
augcugcccagcaccauccagacccucacgcuguuccugaccuccggcggggugcuccugagccuguacgucuccgccagccucuccuaccugcuguacagcgacauccuccugaaguucuccccgaccgagaucaacgcccccaccaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90234 - RNA, 1401 nt, Artificial Sequence
  derived and/or modified sequence opt1 from neuraminidase__InfluenzaB__AGX17285
augcugcccagcaccauccagacccucacgcuguuccugaccuccggcggggugcuccugagccuguacauguccgccagccucuccuaccugcuguacagcgacauccuccugaaguucuccccgaccgagaucaccgcccccacgaugccccuggacugcgcgaacgccagcaacguccaggccgugaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccaagcggaugggcauggggcuguacgugaaguacgacggcgaccccugggccgacagcgacgcgcuggcccucuccggggugauggucagcauggaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcugcucugggacaccgucaccggcguggacauggcgcuguga

SEQ ID NO: 90235 - RNA, 1401 nt, Artificial Sequence
  derived and/or modified sequence opt1 from neuraminidase__InfluenzaB__AGX17296
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgaggcgaaggggaacuccgccccgcucaucauccgggagcccuucaucgccugcggccccaaggagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaagaucaaguacggcgaggccuacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggcggacagcgacgcccuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgcgaucuacugccugaugggcuccgggcagcugcucugggacacggugaccggcguggacauggcccuguga

SEQ ID NO: 90236 - RNA, 1401 nt, Artificial Sequence; identical to SEQ ID NO: 90168
  derived and/or modified sequence opt1 from neuraminidase__InfluenzaB__AGX17307

SEQ ID NO: 90237 - RNA, 1401 nt, Artificial Sequence; identical to SEQ ID NO: 89622
  derived and/or modified sequence opt1 from neuraminidase__InfluenzaB__AGX17318

SEQ ID NO: 90238 - RNA, 1401 nt, Artificial Sequence
  derived and/or modified sequence opt1 from neuraminidase__InfluenzaB__AGX17329
augcugcccagcaccauccagacccucacgcuguuccugaccuccggcggggugcuccugagccuguacgucuccgccagccucuccuaccugcuguacagcgacaugcuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacagcggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaacaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagaccuggcacuccgccgccaccgccaucuacugccugaugggcagcgggcagcugcucugggacacggugaccggcguggacauggcgcuguga

SEQ ID NO: 90239 - RNA, 1401 nt, Artificial Sequence; identical to SEQ ID NO: 90170
  derived and/or modified sequence opt1 from neuraminidase__InfluenzaB__AGX17340

SEQ ID NO: 90240 - RNA, 1401 nt, Artificial Sequence
  derived and/or modified sequence opt1 from neuraminidase__InfluenzaB__AGX17351
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgagaccaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcugcucugggacaccgugaccggcguggacauggcgcuguga

SEQ ID NO: 90241 - RNA, 1401 nt, Artificial Sequence
  derived and/or modified sequence opt1 from neuraminidase__InfluenzaB__AGX17362
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaucccccuggacugcgcgaacgccagcaacauccaggccgugaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccaagcggaugggcauggggcuguacgugaaguacgacggcgaccccugggccgacagcgacgcgcuggcccucuccggggugauggucagcauggaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcugcucugggacaccgucaccggcguggacauggcgcuguga

SEQ ID NO: 90242 - RNA, 1401 nt, Artificial Sequence
  derived and/or modified sequence opt1 from neuraminidase__InfluenzaB__AGX17373
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccaacaacaagaccaucgagugcgcgugccgcgacaacagcuacaccgccaagcggcccuucgucaagcugaacguggagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgucaaguacgacggcgaccccugggccgacuccgacgcgcuggcccucagcggggugaugguguccauggaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcugcucugggacaccgugaccggcgucaacauggcgcuguga

SEQ ID NO: 90243 - RNA, 1401 nt, Artificial Sequence; identical to SEQ ID NO: 89622
  derived and/or modified sequence opt1 from neuraminidase__InfluenzaB__AGX17384

SEQ ID NO: 90244 - RNA, 1401 nt, Artificial Sequence; identical to SEQ ID NO: 89690
  derived and/or modified sequence opt1 from neuraminidase__InfluenzaB__AGX17395

SEQ ID NO: 90245 - RNA, 1401 nt, Artificial Sequence
  derived and/or modified sequence opt1 from neuraminidase__InfluenzaB__AGX17404
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggagcgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcgggaucauggucuccauggaggagcccggcugguacagcuucggguucgagaucaaggacaagaagugcgacgugccgugcaucggcaucgagauggugcacgacggcgggaaggagaccuggcacuccgccgccacggccaucuacugccugaugggcagcgggcagcugcucugggacaccgucaccggcguggacauggcgcuguga

SEQ ID NO: 90246 - RNA, 1401 nt, Artificial Sequence
  derived and/or modified sequence opt1 from neuraminidase__InfluenzaB__AGX17415
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggacuggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcugcucugggacaccgugaccggcguggacauggcgcuguga

SEQ ID NO: 90247 - RNA, 1401 nt, Artificial Sequence
  derived and/or modified sequence opt1 from neuraminidase__InfluenzaB__AGX17426
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgaccccugggccgacagcgacgcgcuggcccuguccggggucauggugagcauggaggagccgggcugguacuccuucggguucgagauccgcgacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcgcucuga

SEQ ID NO: 90248 - RNA, 1401 nt, Artificial Sequence
  derived and/or modified sequence opt1 from neuraminidase__InfluenzaB__AGX17437
augcugcccagcaccauccagacccucacgcuguuccugaccuccggcggggugcuccugagccuguacgucuccgugagccucuccuaccugcuguacagcgacauccuccugaaguucuccccgaccgagaucaccgcccagacgaugccccuggacuucgccaacgcgagcaacgugcaggccgucaaccgcuccgccaccaagggcgugacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcccagcccggcggguacuacaacggcacccgcggggaccggaacaagcugcgccaccucaucagcgugaagcugggcaagauccccacggucgagaacuccaucuuccacauggcggccuggagcggguccgccugccacgacggcaaggaguggaccuacaucggcguggacgggccggacaacaacgcccugcucaagaucaaguacggcgaggccuacaccgacaccuaccacagcuacgcgaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgccugccgcgacaacuccuacaccgcgaagcggcccuucgucaagcugaacguggagaccgacacggccgagauccgccugaugugcaccgagaccuaccucgacacgccccggccggacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccugggccgacagcgacgcccuggcgcucuccggggugauggugagcauggaggagcccggcugguacuccuucggguucgagauccgcgacaagaagugcgacgucccgugcaucggcaucgagauggugcacgacggcgggaaggagaccuggcacagcgccgccacggccaucuacugccugaugggcuccgggcagcugcucugggacaccgugaccggcgucgacauggcccuguga

SEQ ID NO: 90249 - RNA, 1401 nt, Artificial Sequence
  derived and/or modified sequence opt1 from neuraminidase__InfluenzaB__AGX17448
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgagaccaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcugguccucagcggggugaugguguccauggaggagccgggcugguacagcuucggguucgagaucaaggacaagaagugcgacguccccugcaucggcaucgagauggugcacgacggcgggaaggagacguggcacuccgccgccaccgccaucuacugccugaugggcagcgggcagcugcucugggacaccgugaccggcgucgacauggcccuguga

SEQ ID NO: 90250 - RNA, 1401 nt, Artificial Sequence
  derived and/or modified sequence opt1 from neuraminidase__InfluenzaB__AGX17459
augcugcccagcaccauccagacccucacgcuguuccugaccuccggcggggugcuccugagccuguacgucuccgccagccucuccuaccugcuguacagcgacauccuccugaaguucuccccgaccgagaucaccgccagcacgaugccccuggacugcgcgaacgccuccaacgugcaggccgugaaccgcagcgccaccaagggcgucacccuccugcugcccgagcccgacuggaccuacccgcggcucuccugccccgggagcacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcuggcccucagcggggucaugguguccauggaggagcccggcugguacagcuucggguucgagaucaaggacaagaagugcgacgugccgugcaucggcaucgagaugguccacgacggcgggaaggagaccuggcacuccgccgccacggccaucuacugccugaugggcagcgggcagcugcucugggacaccgugaccggcguggacauggcgcuguga

SEQ ID NO: 90251 - RNA, 1401 nt, Artificial Sequence; identical to SEQ ID NO: 89622
  derived and/or modified sequence opt1 from neuraminidase__InfluenzaB__AGX17470

SEQ ID NO: 90252 - RNA, 1401 nt, Artificial Sequence
  derived and/or modified sequence opt1 from neuraminidase__InfluenzaB__AGX17481
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccucauccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgaccccugggccgacagcgacgcgcuggcccuguccggggucauggugagcguggaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90253 - RNA, 1401 nt, Artificial Sequence
  derived and/or modified sequence opt1 from neuraminidase__InfluenzaB__AGX17492
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcugcucugggacaccgugaccggcguggacaucgcgcuguga

SEQ ID NO: 90254 - RNA, 1401 nt, Artificial Sequence
  derived and/or modified sequence opt1 from neuraminidase__InfluenzaB__AGX17503
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccgggcugacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucuccgugaagcugggcaagaucccgacgguggagaacagcaucuuccacauggccgccugguccgggagcgccugccacgacggcaaggaguggaccuacaucggcgucgacgggcccgacaacaacgcccuccugaagaucaaguacggcgaggcguacaccgacaccuaccacuccuacgccaacaacauccugcggacgcaggagagcgccugcaacugcaucgggggcaacugcuaccucaugaucaccgacggcuccgccagcgggaucagcgagugccgcuuccugaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccucaugugcaccgagaccuaccuggacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccugggccgacuccgacgcgcucgcccugagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcuccugugggacaccgugaccggcguggacauggcgcuguga

SEQ ID NO: 90255 - RNA, 1401 nt, Artificial Sequence; identical to SEQ ID NO: 89622
  derived and/or modified sequence opt1 from neuraminidase__InfluenzaB__AGX17514

SEQ ID NO: 90256 - RNA, 1401 nt, Artificial Sequence
  derived and/or modified sequence opt1 from neuraminidase__InfluenzaB__AGX17525
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccugggccgacagcgacgcgcuggcccucuccggggucauggugagcauggaggagccgggcugguacuccuucggguucgagauccgcgacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90257 - RNA, 1401 nt, Artificial Sequence; identical to SEQ ID NO: 90201
  derived and/or modified sequence opt1 from neuraminidase__InfluenzaB__AGX17536

SEQ ID NO: 90258 - RNA, 1401 nt, Artificial Sequence; identical to SEQ ID NO: 90232
  derived and/or modified sequence opt1 from neuraminidase__InfluenzaB__AGX17547

SEQ ID NO: 90259 - RNA, 1401 nt, Artificial Sequence
  derived and/or modified sequence opt1 from neuraminidase__InfluenzaB__AGX17558
augcugcccagcaccauccagacccucacgcuguuccugaccuccggcggggugcuccugagccuguacgucuccgccagccucuccuaccugcuguacagcgacgugcuccugaaguucuccccggccgagaucaccgcgcccaccaugccccuggacugcgccaacgccagcaacgugcaggccgucaaccgcuccgccacgaagggcgugacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaaggagugcaagcacuucgcccugacccacuacgcggcccagcccggcggguacuacaacggcacccgcggggaccggaacaagcugcgccaccucaucagcgugaagcugggcaagaucccgaccgucgagaacuccaucuuccacauggccgccuggagcggguccgccugccacgacggcaaggaguggacguacaucggcguggacgggcccgacaacaacgcgcugcucaagaucaaguacggcgaggccuacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggagaccuaccucgacaccccgcggcccgacgacgggagcaucaccggccccugcgaguccaacggcgacaaggggagcggcgggaucaagggcggguucguccaccagcgcauggccuccaagaucggccggugguacagccgcacgauguccaagaccaagcggaugggcauggggcuguacgugaaguacgacggcgaccccugggcggacagcgacgcccuggcccucuccggggugauggucagcauggaggagccgggcugguacuccuucggguucgagaucaaggacaagaagugcgacgugcccugcaucggcaucgagauggugcacgacggcgggaaggagaccuggcacagcgccgccaccgcgaucuacugccugaugggcuccgggcagcugcucugggacacggucaccggcguggacauggcccuguga

SEQ ID NO: 90260 - RNA, 1401 nt, Artificial Sequence; identical to SEQ ID NO: 89751
  derived and/or modified sequence opt1 from neuraminidase__InfluenzaB__AGX17569

SEQ ID NO: 90261 - RNA, 1401 nt, Artificial Sequence; identical to SEQ ID NO: 89678
  derived and/or modified sequence opt1 from neuraminidase__InfluenzaB__AGX17580

SEQ ID NO: 90262 - RNA, 1401 nt, Artificial Sequence
  derived and/or modified sequence opt1 from neuraminidase__InfluenzaB__AGX17591
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggccguucgucaagcugaacguggagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgucaaguacgacggcgacccgugggccgacuccgacgcgcuggccuucagcggggugaugguguccauggaggagcccggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucaacauggcgcucuga

SEQ ID NO: 90263 - RNA, 1401 nt, Artificial Sequence; identical to SEQ ID NO: 89676
  derived and/or modified sequence opt1 from neuraminidase__InfluenzaB__AGX17602

SEQ ID NO: 90264 - RNA, 1401 nt, Artificial Sequence; identical to SEQ ID NO: 90262
  derived and/or modified sequence opt1 from neuraminidase__InfluenzaB__AGX17613

SEQ ID NO: 90265 - RNA, 1401 nt, Artificial Sequence; identical to SEQ ID NO: 89849
  derived and/or modified sequence opt1 from neuraminidase__InfluenzaB__AGX17624

SEQ ID NO: 90266 - RNA, 1401 nt, Artificial Sequence
  derived and/or modified sequence opt1 from neuraminidase__InfluenzaB__AGX17635
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggccguucgugaagcugaacgucgagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgacccgugggccgacuccgacgcgcuggccuucagcggggucaugguguccauggaggagcccggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcgugaacauggcgcucuga

SEQ ID NO: 90267 - RNA, 1401 nt, Artificial Sequence; identical to SEQ ID NO: 89849
  derived and/or modified sequence opt1 from neuraminidase__InfluenzaB__AGX17657

SEQ ID NO: 90268 - RNA, 1401 nt, Artificial Sequence; identical to SEQ ID NO: 90262
  derived and/or modified sequence opt1 from neuraminidase__InfluenzaB__AGX17668

SEQ ID NO: 90269 - RNA, 1401 nt, Artificial Sequence
  derived and/or modified sequence opt1 from neuraminidase__InfluenzaB__AGX17679
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90270 - RNA, 1401 nt, Artificial Sequence; identical to SEQ ID NO: 89849
  derived and/or modified sequence opt1 from neuraminidase__InfluenzaB__AGX17690

SEQ ID NO: 90271 - RNA, 1401 nt, Artificial Sequence
  derived and/or modified sequence opt1 from neuraminidase__InfluenzaB__AGX17701
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcaagcgcggggaccggaacaagcugcgccaccucaucuccgugaagcugggcaagauccccaccguggagaacagcaucuuccacauggccgccugguccgggagcgccugccacgacggcaaggaguggacguacaucggcgucgacgggcccgacaacaacgcccugcucaagaucaaguacggcgaggcguacaccgacaccuaccacuccuacgccaacaacauccugcggacccaggagagcgccugcaacugcaucgggggcaacugcuaccugaugaucacggacggcuccgccagcggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggccguucgucaagcugaacguggagaccgacaccgccgagauccgccugaugugcacggagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgucaaguacgacggcgacccgugggccgacuccgacgcgcuggccuucagcggggugaugguguccauggaggagcccggcugguacagcuucggguucgagaucaaggacaagaagugcgacguccccugcaucggcaucgagauggugcacgacggcgggaaggagaccuggcacuccgccgccaccgccaucuacugccucaugggcagcgggcagcugcugugggacacggugaccggcgucaacauggcgcucuga

SEQ ID NO: 90272 - RNA, 1401 nt, Artificial Sequence; identical to SEQ ID NO: 89849
  derived and/or modified sequence opt1 from neuraminidase__InfluenzaB__AGX17723

SEQ ID NO: 90273 - RNA, 1401 nt, Artificial Sequence; identical to SEQ ID NO: 90269
  derived and/or modified sequence opt1 from neuraminidase__InfluenzaB__AGX17734

SEQ ID NO: 90274 - RNA, 1401 nt, Artificial Sequence
  derived and/or modified sequence opt1 from neuraminidase__InfluenzaB__AGX17745
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugcagcggguccacguuccagaaggcccugcugaucagcccccaccgcuucggcgagaucaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgucaaguacgacggcgaccccugggccgacagcgacgcgcuggccuucuccggggugauggugagcauggaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucaacauggcgcucuga

SEQ ID NO: 90275 - RNA, 1401 nt, Artificial Sequence
  derived and/or modified sequence opt1 from neuraminidase__InfluenzaB__AGX17756
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcgccccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90276 - RNA, 1401 nt, Artificial Sequence; identical to SEQ ID NO: 89896
  derived and/or modified sequence opt1 from neuraminidase__InfluenzaB__AGX17767

SEQ ID NO: 90277 - RNA, 1401 nt, Artificial Sequence
  derived and/or modified sequence opt1 from neuraminidase__InfluenzaB__AGX17778
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgagagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90278 - RNA, 1401 nt, Artificial Sequence
  derived and/or modified sequence opt1 from neuraminidase__InfluenzaB__AGX17789
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcugguguucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 90279 - RNA, 1401 nt, Artificial Sequence; identical to SEQ ID NO: 89849
  derived and/or modified sequence opt1 from neuraminidase__InfluenzaB__AGX17800

SEQ ID NO: 90280 - RNA, 1401 nt, Artificial Sequence
  derived and/or modified sequence opt1 from neuraminidase__InfluenzaB__AGX17811
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggccguucgucaagcugaacguggagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgucaaguacgacggcgacccgugggccgacuccgacgcgcuggccuucagcggggugaugguguccauggaggagcccggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucaacauggcgcaguga

SEQ ID NO: 90281 - RNA, 1401 nt, Artificial Sequence; identical to SEQ ID NO: 90262
  derived and/or modified sequence opt1 from neuraminidase__InfluenzaB__AGX17822

SEQ ID NO: 90282 - RNA, 1401 nt, Artificial Sequence
  derived and/or modified sequence opt1 from neuraminidase__InfluenzaB__AGX17833
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccaucaagcugggcaagauccccacgguggagaacagcaucuuccacauggccgccugguccgggagcgccugccacgacggcaaggaguggaccuacaucggcguggacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggccguucgugaagcugaacgucgagaccgacacggccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgacccgugggccgacuccgacgcgcuggccuucagcggggucaugguguccauggaggagcccggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcgugaacauggcgcucuga

SEQ ID NO: 90283 - RNA, 1401 nt, Artificial Sequence; identical to SEQ ID NO: 90269
  derived and/or modified sequence opt1 from neuraminidase__InfluenzaB__AGX17844

SEQ ID NO: 90284 - RNA, 1401 nt, Artificial Sequence; identical to SEQ ID NO: 90277
  derived and/or modified sequence opt1 from neuraminidase__InfluenzaB__AGX17855

SEQ ID NO: 90285 - RNA, 1401 nt, Artificial Sequence; identical to SEQ ID NO: 89896
  derived and/or modified sequence opt1 from neuraminidase__InfluenzaB__AGX17866

SEQ ID NO: 90286 - RNA, 1401 nt, Artificial Sequence; identical to SEQ ID NO: 90262
  derived and/or modified sequence opt1 from neuraminidase__InfluenzaB__AGX17877

SEQ ID NO: 90287 - RNA, 1401 nt, Artificial Sequence; identical to SEQ ID NO: 90269
  derived and/or modified sequence opt1 from neuraminidase__InfluenzaB__AGX17888

SEQ ID NO: 90288 - RNA, 1401 nt, Artificial Sequence; identical to SEQ ID NO: 90262
  derived and/or modified sequence opt1 from neuraminidase__InfluenzaB__AGX17899

SEQ ID NO: 90289 - RNA, 1401 nt, Artificial Sequence; identical to SEQ ID NO: 90269
  derived and/or modified sequence opt1 from neuraminidase__InfluenzaB__AGX17910

SEQ ID NO: 90290 - RNA, 1401 nt, Artificial Sequence; identical to SEQ ID NO: 90269
  derived and/or modified sequence opt1 from neuraminidase__InfluenzaB__AGX17921

SEQ ID NO: 90291 - RNA, 1401 nt, Artificial Sequence; identical to SEQ ID NO: 89896
  derived and/or modified sequence opt1 from neuraminidase__InfluenzaB__AGX17932

SEQ ID NO: 90292 - RNA, 1401 nt, Artificial Sequence
  derived and/or modified sequence opt1 from neuraminidase__InfluenzaB__AGX17943
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugcggcugggcaagauccccacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcgcacgcaggagagcgccugcaacugcaucgggggcaacugcuaccugaugaucaccgacggcuccgccagcggggugagcgagugccgguuccucaagauccgcgagggccggaucaucaaggagaucuuccccaccgggcgcgugaagcacaccgaggagugcacgugcggcuucgccuccaacaagaccaucgagugcgcgugccgggacaacagcuacaccgccaagcgcccguucgucaagcugaacguggagaccgacacggccgagauccggcugaugugcaccgagaccuaccucgacacgccccgccccgacgacggguccaucaccggccccugcgagagcaacggcgacaagggguccggcgggaucaagggcggguucgugcaccagcggauggccagcaagaucggccgcugguacucccggaccaugagcaagaccaagcgcaugggcauggggcuguacgucaaguacgacggcgacccgugggccgacuccgacgcgcuggccuucagcggggugaugguguccauggaggagcccggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucaacauggcgcucuga

SEQ ID NO: 90293 - RNA, 1401 nt, Artificial Sequence; identical to SEQ ID NO: 90262
  derived and/or modified sequence opt1 from neuraminidase__InfluenzaB__AGX17954

SEQ ID NO: 90294 - RNA, 1401 nt, Artificial Sequence
  derived and/or modified sequence opt1 from neuraminidase__InfluenzaB__AGX17976
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacgccccuccugccggagcccgaguggaccuacccccggcugagcugccccggguccaccuuccagaaggcccuccugaucagcccgcaccgcuucggcgagaccaaggggaacuccgcgccccugaucauccgggagcccuucaucgccugcggccccaacgagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggccguucgucaagcucaacguggagaccgacacggccgagauccgccugaugugcaccgacaccuaccuggacacgccccggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcucuacgucaaguacgacggcgacccgugggccgacagcgacgcgcuggccuucuccggggugauggugagcaugaaggagcccggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcgcuguga

SEQ ID NO: 90295 - RNA, 1401 nt, Artificial Sequence
  derived and/or modified sequence opt1 from neuraminidase__InfluenzaB__AGX17987
augcugcccagcaccauccagacccucacgcuguuccugaccuccggcggggugcuccugagccuguacgucuccgugagccucuccuaccugcuguacagcgacauccuccugaaguucccgcccaccgagaucaccgcccccacgaugccccuggacugcgccaacgcguccaacgugcaggccgucaaccgcagcgccaccaagggcgugacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcccagccgggcggguacuacaacggcacccgcggggaccggaacaagcugcgccaccucaucuccgugaagcugggcaagauccccacggucgagaacagcaucuuccacauggcggccugguccgggagcgccugccacgacggcaaggaguggaccuacaucggcguggacgggcccgacaacaacgcccugcucaagaucaaguacggcgaggccuacaccgacaccuaccacuccuacgcgaacaacauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggucaagcacaccgaggagugcacgugcggcuucgccuccaacaagaccaucgagugcgccugccgcgacaacagcuacaccgcgaagcggccguucgugaagcugaacguggagaccgacacggccgagauccgccugaugugcaccgagaccuaccucgacacgccccggcccgacgacggguccaucaccggccccugcgagagcaacggcgacaagggguccggcgggaucaagggcggguucguccaccagcgcauggccagcaagaucggccggugguacucccgcaccaugagcaagaccaagcggaugggcauggggcuguacgugaaguacgacggcgacccgugggccgacuccgacgcccuggcguucagcggggugauggucuccauggaggagcccggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcgugaacauggcccucuga

SEQ ID NO: 90296 - RNA, 1401 nt, Artificial Sequence; identical to SEQ ID NO: 90269
  derived and/or modified sequence opt1 from neuraminidase__InfluenzaB__AGX17998

SEQ ID NO: 90297 - RNA, 1401 nt, Artificial Sequence; identical to SEQ ID NO: 90262
  derived and/or modified sequence opt1 from neuraminidase__InfluenzaB__AGX18009

SEQ ID NO: 90298 - RNA, 1401 nt, Artificial Sequence; identical to SEQ ID NO: 90295
  derived and/or modified sequence opt1 from neuraminidase__InfluenzaB__AGX18020

SEQ ID NO: 90299 - RNA, 1401 nt, Artificial Sequence; identical to SEQ ID NO: 90262
  derived and/or modified sequence opt1 from neuraminidase__InfluenzaB__AGX18031

SEQ ID NO: 90300 - RNA, 1401 nt, Artificial Sequence
  derived and/or modified sequence opt1 from neuraminidase__InfluenzaB__AGX18042
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccugaacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90301 - RNA, 1401 nt, Artificial Sequence; identical to SEQ ID NO: 90269
  derived and/or modified sequence opt1 from neuraminidase__InfluenzaB__AGX18053

SEQ ID NO: 90302 - RNA, 1401 nt, Artificial Sequence; identical to SEQ ID NO: 90269
  derived and/or modified sequence opt1 from neuraminidase__InfluenzaB__AGX18064

SEQ ID NO: 90303 - RNA, 1401 nt, Artificial Sequence
  derived and/or modified sequence opt1 from neuraminidase__InfluenzaB__AGX18075
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaacagcaucuuccacauggccgccugguccgggagcuccugccacgacggcaaggaguggaccuacaucggcgucgacgggcccgacaacaacgcccugcucaagaucaaguacggcgaggccuacaccgacaccuaccacagcuacgcgaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgccugccgcgacaacuccuacaccgcgaagcggccguucgucaagcugaacguggagaccgacacggccgagauccgccugaugugcaccgagaccuaccucgacacgccccggcccgacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcuguacgucaaguacgacggcgacccgugggccgacagcgacgcccuggcguucuccggggugauggugagcauggaggagcccggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucaacauggcccucuga

SEQ ID NO: 90304 - RNA, 1401 nt, Artificial Sequence; identical to SEQ ID NO: 89896
  derived and/or modified sequence opt1 from neuraminidase__InfluenzaB__AGX18086

SEQ ID NO: 90305 - RNA, 1401 nt, Artificial Sequence; identical to SEQ ID NO: 89896
  derived and/or modified sequence opt1 from neuraminidase__InfluenzaB__AGX18097

SEQ ID NO: 90306 - RNA, 1401 nt, Artificial Sequence; identical to SEQ ID NO: 89849
  derived and/or modified sequence opt1 from neuraminidase__InfluenzaB__AGX18108

SEQ ID NO: 90307 - RNA, 1401 nt, Artificial Sequence
  derived and/or modified sequence opt1 from neuraminidase__InfluenzaB__AGX18119
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacaccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacauggagaccgacaccgccgagaucaagcugaugugcaccgacaccuaccucgacacgccgcgccccgacgacgggagcaucaccggccccugcgaguccaacggcgacaaggggagcggcgggaucaagggcggguucgugcaccagcggauggccuccaagaucggccgcugguacagccggaccauguccaagaccgagcgcaugggcauggggcuguacgugaaguacgacggcgaccccugggccgacagcgacgcccuggcguucuccggggucauggugagcaugaaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcguggacauggcccucuga

SEQ ID NO: 90308 - RNA, 1401 nt, Artificial Sequence
  derived and/or modified sequence opt1 from neuraminidase__InfluenzaB__AGX18130
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgaugucccggaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90309 - RNA, 1401 nt, Artificial Sequence
  derived and/or modified sequence opt1 from neuraminidase__InfluenzaB__AGX18141
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgagagcgacgcgcuggccuucuccggggugauggucagcauggaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcgugaacauggcgcucuga

SEQ ID NO: 90310 - RNA, 1401 nt, Artificial Sequence; identical to SEQ ID NO: 89896
  derived and/or modified sequence opt1 from neuraminidase__InfluenzaB__AGX18152

SEQ ID NO: 90311 - RNA, 1401 nt, Artificial Sequence
  derived and/or modified sequence opt1 from neuraminidase__InfluenzaB__AGX18163
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgugaaguacgacggcgaccccugggccgacagcgacgcgcuggccuucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccucaugggcuccgggcagcugcugugggacacggugaccggcgugaacauggcgcucuga

SEQ ID NO: 90312 - RNA, 1401 nt, Artificial Sequence; identical to SEQ ID NO: 90262
  derived and/or modified sequence opt1 from neuraminidase__InfluenzaB__AGX18174

SEQ ID NO: 90313 - RNA, 1401 nt, Artificial Sequence; identical to SEQ ID NO: 89896
  derived and/or modified sequence opt1 from neuraminidase__InfluenzaB__AGX18185

SEQ ID NO: 90314 - RNA, 1401 nt, Artificial Sequence; identical to SEQ ID NO: 89849
  derived and/or modified sequence opt1 from neuraminidase__InfluenzaB__AGX18196

SEQ ID NO: 90315 - RNA, 1401 nt, Artificial Sequence
  derived and/or modified sequence opt1 from neuraminidase__InfluenzaB__AGX18207
augcugcccagcaccauccagacccucacgcuguuccugaccuccggcggggugcuccugagccuguacgucuccgccagccucuccuaccugcuguacagcgacauccuccugaaguucccgcccaccgagaucaccgcccccacgaugccccuggacugcgcgaacgccuccaacgugcaggccgugaaccgcagcgccaccaagggcgucacccuccugcugccggagcccgaguggaccuacccccggcucuccugccccgggagcacguuccagaaggcccugcugaucuccccgcaccgcuucggcgagaccaaggggaacagcgcgccccucaucauccgggagcccuucaucgccugcggccccaaggagugcaagcacuucgcccugacccacuacgccgcgcagccgggcggguacuacaacggcacccgcggggaccggaacaagcugcgccaccucaucuccgugaagcugggcaagauccccacgguggagaccagcaucuuccacauggccgccugguccgggagcgccugccacgacggcaaggaguggaccuacaucggcgucgacgggcccgacaacaacgcccugcucaagaucaaguacggcgaggcguacaccgacacguaccacuccuacgccaacaacauccugcggacccaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggugaagcacacggaggagugcacgugcggcuucgccuccaacaagaccaucgagugcgcgugccgcgacaacagcuacaccgccaagcggccguucgucaagcugaacguggagaccgacaccgccgagauccgccugaugugcaccgagaccuaccucgacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccaagcggaugggcauggggcuguacgucaaguacgacggcgacccgugggccgacuccgacgcgcuggccuucagcggggugaugguguccauggaggagcccggcugguacagcuucggguucgagaucaaggacaagaagugcgacguccccugcaucggcaucgagauggugcacgacggcgggaaggagacguggcacuccgccgccaccgccaucuacugccucaugggcagcgggcagcugcugugggacaccgugaccggcgucaacauggcgcucuga

SEQ ID NO: 90316 - RNA, 1401 nt, Artificial Sequence
  derived and/or modified sequence opt1 from neuraminidase__InfluenzaB__AGX18218
augcugcccagcaccauccagacccucacgcuguuccugaccuccggcggggugcuccugagccuguacgucuccgccagccucuccuaccugcuguacagcgacauccuccugaagcuguccccgaccgagaucaccgcccccacgaugccccucgacugcgcgaacaccagcaacgugcaggccgugaaccgcuccgccaccaagggcgucacccugcugcuccccgagccggaguggacguacccccggcugagcugccccggguccaccuuccagaaggcccugcucaucagcccccaccgcuucggcgagaccaaggggaacuccgccccgcugaucauccgggagcccuucaucgcgugcggccccaacgagugcaagcacuucgcccugacccacuacgccgcccagcccggcggguacuacaaccgcacgcggggcgaccgcaacaagcuccggcaccugaucagcgugaagcuggggaagaucccgaccguggagaacuccaucuuccacauggcggccuggagcggcuccgccugccacgacgggaaggaguggaccuacaucggcgucgacggccccgacaacaacgcccuccugaagaucaaguacggggaggccuacaccgacacguaccacagcuacgcgaacaacauccugcgcacccaggaguccgccugcaacugcaucggcgggaacugcuaccucaugaucaccgacggcagcgccagcggcguguccgagugccgguuccugaagauccgcgaggggcggaucaucaaggagaucuuccccaccggccgcgugaagcacacggaggagugcacgugcggguucgccagcaacaagaccaucgagugcgccugccgggacaacuccuacaccgcgaagcgccccuucgucaagcugaacauggagaccgacaccgccgagauccggcucaugugcaccgacaccuaccuggacacgccgcgccccgacgacggcagcaucaccgggcccugcgaguccaacggcgacaagggcagcgggggcaucaagggcggguucgugcaccagcggauggccuccaagaucgggcgcugguacagccggaccauguccaagaccgagcgcaugggcaugggccuguacgugaaguacgacggggaccccugggccgacagcgacgcccucgcguucuccggcgucauggugagcaugaaggagccggggugguacuccuucggcuucgagaucaaggacaagaagugcgacgugcccugcaucgggaucgagaugguccacgacggcggcaaggagacguggcacagcgccgccaccgccaucuacugccugaugggguccggccagcugcucugggacaccgugaccgggguggacauggcccuguga

SEQ ID NO: 90317 - RNA, 1401 nt, Artificial Sequence; identical to SEQ ID NO: 90269
  derived and/or modified sequence opt1 from neuraminidase__InfluenzaB__AGX18229

SEQ ID NO: 90318 - RNA, 1401 nt, Artificial Sequence
  derived and/or modified sequence opt1 from neuraminidase__InfluenzaB__AGX18240
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcagaccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacguggagaucgacaccgccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcccuggcguucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 90319 - RNA, 1401 nt, Artificial Sequence; identical to SEQ ID NO: 90262
  derived and/or modified sequence opt1 from neuraminidase__InfluenzaB__AGX18251

SEQ ID NO: 90320 - RNA, 1401 nt, Artificial Sequence
  derived and/or modified sequence opt1 from neuraminidase__InfluenzaB__AGX18262
augcugcccagcaccauccagacccucacgcuguuccugaccuccggcggggugcuccugagccuguacgucuccgccagccucuccuaccugcuguacagcaacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaaggucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90321 - RNA, 1401 nt, Artificial Sequence; identical to SEQ ID NO: 90269
  derived and/or modified sequence opt1 from neuraminidase__InfluenzaB__AGX18273

SEQ ID NO: 90322 - RNA, 1401 nt, Artificial Sequence; identical to SEQ ID NO: 90294
  derived and/or modified sequence opt1 from neuraminidase__InfluenzaB__AGX18284

SEQ ID NO: 90323 - RNA, 1401 nt, Artificial Sequence; identical to SEQ ID NO: 90269
  derived and/or modified sequence opt1 from neuraminidase__InfluenzaB__AGX18295

SEQ ID NO: 90324 - RNA, 1401 nt, Artificial Sequence; identical to SEQ ID NO: 89896
  derived and/or modified sequence opt1 from neuraminidase__InfluenzaB__AGX18306

SEQ ID NO: 90325 - RNA, 1401 nt, Artificial Sequence
  derived and/or modified sequence opt1 from neuraminidase__InfluenzaB__AGX18317
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacgagacccgcggcgaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcggacgcaggaguccgccugcaacugcaucggcgggaacugcuaccugaugaucaccgacggcagcgccagcggcguguccgagugccgcuuccucaagauccgggaggggcgcaucaucaaggagaucuuccccaccggccggaucaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccugggccgacagcgacgcgcuggccuucuccggcgucauggugagcauggaggagccggggugguacuccuucggcuucgagaucaaggacaagaagugcgacgugcccugcaucgggaucgagaugguccacgacggcggcaaggagaccuggcacagcgccgccacggccaucuacugccucaugggguccggccagcugcugugggacaccgugaccggggugaacauggcgcucuga

SEQ ID NO: 90326 - RNA, 1401 nt, Artificial Sequence; identical to SEQ ID NO: 90269
  derived and/or modified sequence opt1 from neuraminidase__InfluenzaB__AGX18328

SEQ ID NO: 90327 - RNA, 1401 nt, Artificial Sequence
  derived and/or modified sequence opt1 from neuraminidase__InfluenzaB__AGX18339
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaaggucggccggugguacagccgcaccauguccaagaccgagcggaugggcauggggcuguacgugaaguacgacggcgaccccugggccgacagcgacgcgcuggccuucgggggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucaccggcguggacauggcgcucuga

SEQ ID NO: 90328 - RNA, 1401 nt, Artificial Sequence
  derived and/or modified sequence opt1 from neuraminidase__InfluenzaB__AGX18350
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccaugaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgugaaguacgacggcgaccccugggccgacagcgacgcgcuggccuucuccggggucauggugagcaugaaggagccgggcugguacuccuucggguucgagaucaaggacaagaagugcgacgugcccugcaucggcaucgagaugguccacgacggcgggaaggagaccuggcacagcgccgccaccgccaucuacugccucaugggcuccgggcagcugcugugggacacggugaccggcguggacauggcgcucuga

SEQ ID NO: 90329 - RNA, 1401 nt, Artificial Sequence; identical to SEQ ID NO: 90294
  derived and/or modified sequence opt1 from neuraminidase__InfluenzaB__AGX18361

SEQ ID NO: 90330 - RNA, 1401 nt, Artificial Sequence
  derived and/or modified sequence opt1 from neuraminidase__InfluenzaB__AGX18383
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacaccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacauggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcccuggucuucuccggggugauggugagcaugaaggagccgggcugguacuccuucggguucgagaucaaggacaagaagugcgacguccccugcaucggcaucgagauggugcacggcgggggcaaggagacguggcacagcgcggccaccgccaucuacugccucaugggguccggccagcugcugugggacaccgugaccggcgucgacauggcccucuga

SEQ ID NO: 90331 - RNA, 1401 nt, Artificial Sequence; identical to SEQ ID NO: 89896
  derived and/or modified sequence opt1 from neuraminidase__InfluenzaB__AGX18394

SEQ ID NO: 90332 - RNA, 1401 nt, Artificial Sequence
  derived and/or modified sequence opt1 from neuraminidase__InfluenzaB__AGX18405
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacgccccuccugccggagcccgaguggaccuacccccggcugagcugccccggguccaccuuccagaaggcccuccugaucagcccgcaccgcuucggcgagaccaaggggaacuccgcgccccugaucauccgggagcccuucaucgccugcggccccaacgagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgucugccgcgacaacuccuacaccgcgaagcggccguucgugaagcucaacguggagaccgacacggccgagauccgccugaugugcaccgacaccuaccuggacacgccccggcccgacgacgggagcaucaccggccccugcgaguccaacggcgacaaggggagcggcgggaucaagggcggguucguccaccagcgcauggccuccaagaucggccggugguacagccgcaccauguccaagaccgagcggaugggcauggggcucuacgugaaguacgacggcgacccgugggccgacagcgacgcccuggcguucuccggggugauggucagcaugaaggagcccggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcuccugugggacaccgucaccggcguggacauggcccuguga

SEQ ID NO: 90333 - RNA, 1401 nt, Artificial Sequence
  derived and/or modified sequence opt1 from neuraminidase__InfluenzaB__AGX18416
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggcuccugcgagagcaacggcgacaagggguccggcgggaucaagggcggguucgugcaccagcgcauggccagcaagaucggccggugguacucccgcacgaugagcaagaccgagcggaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccaccgccaucuacugccucaugggcagcgggcagcugcugugggacacggugaccggcgucgacauggcgcucuga

SEQ ID NO: 90334 - RNA, 1401 nt, Artificial Sequence
  derived and/or modified sequence opt1 from neuraminidase__InfluenzaB__AGX18428
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacaccgacacguaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcugaacgucgagaccgacaccgccgagauccgccugaugugcaccgagaccuaccucgacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaucgacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagacguggcacuccgccgccaccgccaucuacugccugauggggagcggccagcugcucugggacaccgugaccgggguggacauggcccuguga

SEQ ID NO: 90335 - RNA, 1401 nt, Artificial Sequence
  derived and/or modified sequence opt1 from neuraminidase__InfluenzaB__AGX18439
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaucgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccgggcucauggugagcaugaaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90336 - RNA, 1401 nt, Artificial Sequence
  derived and/or modified sequence opt1 from neuraminidase__InfluenzaB__AGX18450
augcugcccagcaccauccagacccucacgcuguuccugaccuccggcggggugcuccugagccuguacgucuccgccagccucuccuaccugcuguacagcgacauccuccugaaguucuccccgaccgagaucaccgccagcacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaucgacaccgccgagauccgccugaugugcacggacaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccaccgccaucuacugccucaugggcagcgggcagcugcugugggacacggugaccggcgucgacauggcgcucuga

SEQ ID NO: 90337 - RNA, 1401 nt, Artificial Sequence; identical to SEQ ID NO: 89896
  derived and/or modified sequence opt1 from neuraminidase__InfluenzaB__AGX18461

SEQ ID NO: 90338 - RNA, 1401 nt, Artificial Sequence
  derived and/or modified sequence opt1 from neuraminidase__InfluenzaB__AGX18472
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccacuccgccaccaagggcgucacgccccuccugccggagcccgaguggaccuacccccgccugagcugccccggguccaccuuccagaaggcccuccugaucagcccgcaccgguucggcgagaccaaggggaacuccgcgccccugaucauccgcgagcccuucaucgccugcggccccaacgagugcaagcacuucgcccucacccacuacgccgcgcagccgggcggguacuacaacggcacccgcggggaccggaacaagcugcggcaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccgcacgcaggaguccgccugcaacugcaucgggggcaacugcuaccugaugaucaccgacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgcccguucgucaagcucaacguggagaccgacacggccgagauccggcugaugugcaccgacaccuaccuggacacgccccgccccgacgacgggagcaucaccggccccugcgaguccaacggcgacaaggggagcggcgggaucaagggcggguucgugcaccagcggauggccuccaagaucggccgcugguacagccggaccauguccaagaccgagcgcaugggcauggggcucuacgucaaguacgacggcgacccgugggccgacagcgacgcgcuggccuucuccggggugauggugagcaugaaggagcccggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcgcuguga

SEQ ID NO: 90339 - RNA, 1401 nt, Artificial Sequence; identical to SEQ ID NO: 89896
  derived and/or modified sequence opt1 from neuraminidase__InfluenzaB__AGX18483

SEQ ID NO: 90340 - RNA, 1401 nt, Artificial Sequence; identical to SEQ ID NO: 89643
  derived and/or modified sequence opt1 from neuraminidase__InfluenzaB__AGX18494

SEQ ID NO: 90341 - RNA, 1401 nt, Artificial Sequence
  derived and/or modified sequence opt1 from neuraminidase__InfluenzaB__AGX18505
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccaucuccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90342 - RNA, 1401 nt, Artificial Sequence
  derived and/or modified sequence opt1 from neuraminidase__InfluenzaB__AGX18516
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccaucuccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacggcgggggcaaggagaccuggcacagcgccgccacggccaucuacugccucaugggguccggccagcugcugugggacaccgugaccggcgucgacauggcgcucuga

SEQ ID NO: 90343 - RNA, 1401 nt, Artificial Sequence; identical to SEQ ID NO: 89643
  derived and/or modified sequence opt1 from neuraminidase__InfluenzaB__AGX18527

SEQ ID NO: 90344 - RNA, 1401 nt, Artificial Sequence; identical to SEQ ID NO: 89643
  derived and/or modified sequence opt1 from neuraminidase__InfluenzaB__AGX18538

SEQ ID NO: 90345 - RNA, 1401 nt, Artificial Sequence; identical to SEQ ID NO: 89643
  derived and/or modified sequence opt1 from neuraminidase__InfluenzaB__AGX18549

SEQ ID NO: 90346 - RNA, 1401 nt, Artificial Sequence; identical to SEQ ID NO: 89643
  derived and/or modified sequence opt1 from neuraminidase__InfluenzaB__AGX18560

SEQ ID NO: 90347 - RNA, 1401 nt, Artificial Sequence; identical to SEQ ID NO: 89643
  derived and/or modified sequence opt1 from neuraminidase__InfluenzaB__AGX18571

SEQ ID NO: 90348 - RNA, 1401 nt, Artificial Sequence
  derived and/or modified sequence opt1 from neuraminidase__InfluenzaB__AGX18582
augcugcccagcaccauccagacccucacgcuguuccugaccuccggcggggugcuccugagccuguacguccucgccucccugagcuaccugcucuacuccgacauccugcugaaguucagcccgaccgagaucaccgcccccacgaugccccucgacugcgcgaacgccuccaacgugcacgccgugaaccgcagcgccaccaagggcgucacccugcugcuccccgagccggagugggccuacccccggcuguccugccccgggagcaccuuccagaaggcgcugcucaucagcccccaccgcuucggcgagacgaaggggaacuccgccccgcugaucauccgggagcccuucaucgccugcggccccaacgagugcaagcacuucgcccugacccacuacgcggcccagcccggcggguacuacaacggcacccgcggggaccggaacaagcuccgccaccugaucuccgugaagcugggcaagaucccgaccguggagaacagcaucuuccacauggccgccugguccgggagcgccugccacgacggcaaggaguggacguacaucggcgucgacgggcccgacaacaacgcgcuccugaagaucaaguacggcgaggccuacaccgacaccuaccacuccuacgccaacaacauccugcggacccaggagagcgccugcaacugcaucgggggcaacugcuaccucaugaucacggacggcuccgccagcggggugagcgagugccgcuuccugaagauccgggagggccgcaucaucaaggagaucuuccccaccgggcgggugaagcacaccgaggagugcacgugcggcuucgcguccaacaagaccaucgagugcgccugccgcgacaacagcuacaccgccaagcggcccuucgucaagcugaacguggagaccgacaccgccgagauccgccucaugugcacggacaccuaccuggacaccccgcggcccgacgacggguccaucaccggccccugcgagagcaacggcgacaagggguccggcgggaucaagggcggguucgugcaccagcgcauggccagcaagaucggccggugguacucccgcacgaugagcaagaccgagcggaugggcauggggcuguacgucaaguacgacggcgaccccugggcggacuccgacgcccucgccuucagcggggugaugguguccaugaaggagccgggcugguacagcuucggguucgagaucaaggacaagaagugcgacguccccugcaucggcaucgagauggugcacgacggcgggaaggagaccuggcacuccgccgccaccgcgaucuacugccugaugggcagcgggcagcugcucugggacacggugaccggcgucgacauggcccuguga

SEQ ID NO: 90349 - RNA, 1401 nt, Artificial Sequence; identical to SEQ ID NO: 89643
  derived and/or modified sequence opt1 from neuraminidase__InfluenzaB__AGX18593

SEQ ID NO: 90350 - RNA, 1401 nt, Artificial Sequence; identical to SEQ ID NO: 89643
  derived and/or modified sequence opt1 from neuraminidase__InfluenzaB__AGX18604

SEQ ID NO: 90351 - RNA, 1401 nt, Artificial Sequence
  derived and/or modified sequence opt1 from neuraminidase__InfluenzaB__AGX18615
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcaacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90352 - RNA, 1401 nt, Artificial Sequence
  derived and/or modified sequence opt1 from neuraminidase__InfluenzaB__AGX18626
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucauccugcgggagcccuucaucgccugcggccccaacgagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaagauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccucaugugcaccgacaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcucgccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcugcucugggacaccgugaccggcgucgacauggcgcuguga

SEQ ID NO: 90353 - RNA, 1401 nt, Artificial Sequence; identical to SEQ ID NO: 89643
  derived and/or modified sequence opt1 from neuraminidase__InfluenzaB__AGX18637

SEQ ID NO: 90354 - RNA, 1401 nt, Artificial Sequence; identical to SEQ ID NO: 89643
  derived and/or modified sequence opt1 from neuraminidase__InfluenzaB__AGX18648

SEQ ID NO: 90355 - RNA, 1401 nt, Artificial Sequence; identical to SEQ ID NO: 89643
  derived and/or modified sequence opt1 from neuraminidase__InfluenzaB__AGX18659

SEQ ID NO: 90356 - RNA, 1401 nt, Artificial Sequence; identical to SEQ ID NO: 89643
  derived and/or modified sequence opt1 from neuraminidase__InfluenzaB__AGX18670

SEQ ID NO: 90357 - RNA, 1401 nt, Artificial Sequence
  derived and/or modified sequence opt1 from neuraminidase__InfluenzaB__AGX18681
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucgugcgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90358 - RNA, 1401 nt, Artificial Sequence; identical to SEQ ID NO: 89643
  derived and/or modified sequence opt1 from neuraminidase__InfluenzaB__AGX18692

SEQ ID NO: 90359 - RNA, 1401 nt, Artificial Sequence
  derived and/or modified sequence opt1 from neuraminidase__InfluenzaB__AGX18703
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccucuccgccaccaagggcgucacccugcugcuccccgagccggaguggaccuacccccgccugagcugccccggguccacguuccagaaggcccugcucaucagcccccaccgguucggcgagaccaaggggaacuccgcgccgcugaucauccgcgagcccuucaucgccugcggccccaaggagugcaagcacuucgcccugacccacuacgccgcgcagcccggcggguacuacaacggcacccgcggggaccggaacaagcuccggcaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaagaucaaguacggcgaggcguacaccgacaccuaccacagcuacgccaacaacauccugcgcacgcaggaguccgccugcaacugcaucgggggcaacugcuaccucaugaucaccgacggcagcgccagcgggguguccgagugccgguuccugaagauccgcgagggccggaucaucaaggagaucuuccccaccgggcgcaucaagcacaccgaggagugcacgugcggcuucgccagcaacaagaccaucgagugcgcgugccgggacaacuccuacaccgccaagcgccccuucgugaagcugaacgucgagaccgacacggccgagauccggcucaugugcaccgagaccuaccuggacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgugaaguacgacggcgaccccugggccgacagcgacgcgcucgccuucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccugaugggcuccgggcagcugcucugggacaccgugaccggcgugaacauggcgcuguga

SEQ ID NO: 90360 - RNA, 1401 nt, Artificial Sequence; identical to SEQ ID NO: 89643
  derived and/or modified sequence opt1 from neuraminidase__InfluenzaB__AGX18714

SEQ ID NO: 90361 - RNA, 1401 nt, Artificial Sequence; identical to SEQ ID NO: 89643
  derived and/or modified sequence opt1 from neuraminidase__InfluenzaB__AGX18725

SEQ ID NO: 90362 - RNA, 1401 nt, Artificial Sequence
  derived and/or modified sequence opt1 from neuraminidase__InfluenzaB__AGX18736
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcaccgggggcgaccgcaacaagcugcggcaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaagaucaaguacggggaggcguacaccgacaccuaccacagcuacgccaacaagauccugcgcacgcaggaguccgccugcaacugcaucggcggcaacugcuaccugaugaucaccgacgggagcgccagcggcguguccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacggcagcaucacgggccccugcgaguccaacggggacaagggcagcgggggcaucaagggcggguucgugcaccagcggauggccuccaagaucggccgcugguacagccggaccauguccaagaccgagcgcauggggaugggccuguacgucaaguacgacggggaccccugggccgacagcgacgcgcuggccuucuccggcgugauggugagcaugaaggagccggggugguacuccuucggcuucgagaucaaggacaagaagugcgacguccccugcaucggcaucgagauggugcacgacgggggcaaggagaccuggcacagcgccgccacggccaucuacugccucaugggguccggccagcugcugugggacaccgugaccggcgucgacauggcgcucuga

SEQ ID NO: 90363 - RNA, 1401 nt, Artificial Sequence; identical to SEQ ID NO: 89643
  derived and/or modified sequence opt1 from neuraminidase__InfluenzaB__AGX18758

SEQ ID NO: 90364 - RNA, 1401 nt, Artificial Sequence; identical to SEQ ID NO: 89643
  derived and/or modified sequence opt1 from neuraminidase__InfluenzaB__AGX18769

SEQ ID NO: 90365 - RNA, 1401 nt, Artificial Sequence; identical to SEQ ID NO: 90102
  derived and/or modified sequence opt1 from neuraminidase__InfluenzaB__AGX18780

SEQ ID NO: 90366 - RNA, 1401 nt, Artificial Sequence; identical to SEQ ID NO: 89643
  derived and/or modified sequence opt1 from neuraminidase__InfluenzaB__AGX18791

SEQ ID NO: 90367 - RNA, 1401 nt, Artificial Sequence; identical to SEQ ID NO: 89643
  derived and/or modified sequence opt1 from neuraminidase__InfluenzaB__AGX18802

SEQ ID NO: 90368 - RNA, 1401 nt, Artificial Sequence
  derived and/or modified sequence opt1 from neuraminidase__InfluenzaB__AGX18813
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcuggucuucuccggggugauggugagcauggaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucaacauggcccucuga

SEQ ID NO: 90369 - RNA, 1401 nt, Artificial Sequence; identical to SEQ ID NO: 90102
  derived and/or modified sequence opt1 from neuraminidase__InfluenzaB__AGX18824

SEQ ID NO: 90370 - RNA, 1401 nt, Artificial Sequence
  derived and/or modified sequence opt1 from neuraminidase__InfluenzaB__AGX18846
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugagcgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 90371 - RNA, 1401 nt, Artificial Sequence; identical to SEQ ID NO: 89643
  derived and/or modified sequence opt1 from neuraminidase__InfluenzaB__AGX18857

SEQ ID NO: 90372 - RNA, 1401 nt, Artificial Sequence; identical to SEQ ID NO: 90370
  derived and/or modified sequence opt1 from neuraminidase__InfluenzaB__AGX18868

SEQ ID NO: 90373 - RNA, 1401 nt, Artificial Sequence; identical to SEQ ID NO: 90370
  derived and/or modified sequence opt1 from neuraminidase__InfluenzaB__AGX18879

SEQ ID NO: 90374 - RNA, 1401 nt, Artificial Sequence
  derived and/or modified sequence opt1 from neuraminidase__InfluenzaB__AGX18890
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcuggccuucuccggggucauggugagcauggaggagccgggcugguacuccuucggguucgagaucaaggacaagaagugcgacgugcccugcaucggcaucgagaugguccacgacggcgggaaggagaccuggcacagcgccgccacgaccaucuacugccucaugggcuccgggcagcugcugugggacaccgugaccggcgugaacauggcccucuga

SEQ ID NO: 90375 - RNA, 1401 nt, Artificial Sequence; identical to SEQ ID NO: 89643
  derived and/or modified sequence opt1 from neuraminidase__InfluenzaB__AGX18912

SEQ ID NO: 90376 - RNA, 1401 nt, Artificial Sequence
  derived and/or modified sequence opt1 from neuraminidase__InfluenzaB__AGX18923
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaaccgcacccggggcgaccgcaacaagcugcggcaccucaucagcgugaagcuggggaagaucccgacgguggagaacuccaucuuccacauggccgccuggagcggcuccgccugccacgacgggaaggaguggaucuacaucggcgucgacggccccgacaacaacgcccugcucaagaucaaguacggggaggcguacaccgacaccuaccacagcuacgccaacaagauccugcgcacccaggaguccgccugcaacugcaucggcgggaacugcuaccugaugaucacggacggcagcgccagcggcguguccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcugaacguggagaccgacaccgccgagauccggcugaugugcacggacaccuaccucgacaccccgcgccccgacgacggcagcaucaccgggcccugcgaguccaacggcgacaagggcagcgggggcaucaagggcggguucgugcaccagcggauggccuccaagaucgggcgcugguacagccggacgauguccaagaccgagcgcaugggcaugggccuguacgucaaguacgacggggaccccugggccgacagcgacgcgcuggccuucuccggcgugauggugagcaugaaggagccggggugguacuccuucggcuucgagaucaaggacaagaagugcgacguccccugcaucgggaucgagauggugcacgacggcggcaaggagaccuggcacagcgccgccaccgccaucuacugccucaugggguccggccagcugcugugggacacggugaccggggucgacauggcgcucuga

SEQ ID NO: 90377 - RNA, 1401 nt, Artificial Sequence; identical to SEQ ID NO: 89643
  derived and/or modified sequence opt1 from neuraminidase__InfluenzaB__AGX18934

SEQ ID NO: 90378 - RNA, 1401 nt, Artificial Sequence
  derived and/or modified sequence opt1 from neuraminidase__InfluenzaB__AGX18956
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacgucgccgccuggagcggguccgccugccacgacggcaaggaguggaccuacaucggcguggacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90379 - RNA, 1401 nt, Artificial Sequence
  derived and/or modified sequence opt1 from neuraminidase__InfluenzaB__AGX18967
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacgccccuccugccggagcccgaguggaccuacccccggcugagcugccccggguccaccuuccagaaggcccuccugaucagcccgcaccgcuucggcgagaccaaggggaacuccgcgccccugaucauccgggagcccuucaucgccugcggccccaacgagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggccguucgucaagcucaacguggagaccgacacggccgagauccgccugaugugcaccgacaccuaccuggacacgccccggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcucuacgucaaguacgacggcgacccgugggccgacagcgacgcgcuggccuucuccggggugauggugagcaugaaggagcccggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcgcuguga

SEQ ID NO: 90380 - RNA, 1401 nt, Artificial Sequence; identical to SEQ ID NO: 90102
  derived and/or modified sequence opt1 from neuraminidase__InfluenzaB__AGX18978

SEQ ID NO: 90381 - RNA, 1401 nt, Artificial Sequence
  derived and/or modified sequence opt1 from neuraminidase__InfluenzaB__AGX18989
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacuacgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaccaaggagaucuuccccaccgggcgggugaagcacacggaggagugcacgugcggcuucgccagcaacaagaccaucgagugcgcgugccgcgacaacuccuacaccgccaagcggcccuucgucaagcugaacguggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagacguggcacagcgccgccaccgccaucuacugccucaugggcuccgggcagcugcugugggacaccgugaccggcgucgacauggcgcucuga

SEQ ID NO: 90382 - RNA, 1401 nt, Artificial Sequence
  derived and/or modified sequence opt1 from neuraminidase__InfluenzaB__AGX19000
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugaccuacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90383 - RNA, 1401 nt, Artificial Sequence; identical to SEQ ID NO: 89643
  derived and/or modified sequence opt1 from neuraminidase__InfluenzaB__AGX19011

SEQ ID NO: 90384 - RNA, 1401 nt, Artificial Sequence; identical to SEQ ID NO: 89643
  derived and/or modified sequence opt1 from neuraminidase__InfluenzaB__AGX19022

SEQ ID NO: 90385 - RNA, 1401 nt, Artificial Sequence
  derived and/or modified sequence opt1 from neuraminidase__InfluenzaB__AGX19033
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccugaacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcgagggcaucaagggcggguucgugcaccagcgcauggccuccaagaucgggcggugguacagccgcaccauguccaagaccgagcggaugggcaugggccuguacgugaaguacgacggggaccccugggccgacagcgacgcgcuggccuucuccggcgucauggugagcauggaggagccggggugguacuccuucggcuucgagaucaaggacaagaagugcgacgugcccugcaucgggaucgagaugguccacgacggcggcaaggagaccuggcacagcgccgccacggccaucuacugccucaugggguccggccagcugcugugggacaccgugaccggggugaacauggcgcucuga

SEQ ID NO: 90386 - RNA, 1401 nt, Artificial Sequence; identical to SEQ ID NO: 89643
  derived and/or modified sequence opt1 from neuraminidase__InfluenzaB__AGX19044

SEQ ID NO: 90387 - RNA, 1401 nt, Artificial Sequence; identical to SEQ ID NO: 89643
  derived and/or modified sequence opt1 from neuraminidase__InfluenzaB__AGX19055

SEQ ID NO: 90388 - RNA, 1401 nt, Artificial Sequence
  derived and/or modified sequence opt1 from neuraminidase__InfluenzaB__AGX19066
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaucuacaucggcgucgacgggcccgacaacaacgcccugcucaagaucaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90389 - RNA, 1401 nt, Artificial Sequence
  derived and/or modified sequence opt1 from neuraminidase__InfluenzaB__AGX19077
augcugcccagcaccauccagacccucacgcuguuccugaccuccggcggggugcuccugagccuguacgucuccgccagccucuccuaccugcuguacagcgacauccuccugaaguucaccccgaccgagaucacggcccccaccaugccccuggacugcgcgaacgccuccaacgugcaggccgugaaccgcagcgccaccaagggcgucacgccccuccugccggagcccgaguggaccuacccccggcuguccugccccgggagcaccuuccagaaggcccuccugaucuccccgcaccgcuucggcgagaccaaggggaacagcgcgccccugaucauccgggagcccuucaucgccugcggccccaacgagugcaagcacuucgcccucacccacuacgccgcgcagccgggcggguacuacaacggcacgcgcggggaccggaacaagcugcgccaccugaucuccgugaagcucggcaagauccccaccguggagaacagcaucuuccacauggccgccugguccgggagcgccugccacgacggcaaggaguggaccuacaucggcgucgacgggcccgacaacaacgcccugcugaagaucaaguacggcgaggcguacaccgacacguaccacuccuacgccaacaagauccuccggacccaggagagcgccugcaacugcaucgggggcaacugcuaccugaugaucaccgacggcuccgccagcggggugagcgagugccgcuuccugaagauccgggagggccgcaucaucaaggagaucuuccccaccgggcgggugaagcacacggaggagugcacgugcggcuucgccuccaacaagaccaucgagugcgcgugccgcgacaacagcuacaccgccaagcggccguucgucaagcucaacguggagaccgacaccgccgagauccgccugaugugcaccgacaccuaccuggacacgccccggcccgacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcucuacgucaaguacgacggcgacccgugggccgacuccgacgcgcuggccuucagcggggugaugguguccaugaaggagcccggcugguacagcuucggguucgagaucaaggacaagaagugcgacguccccugcaucggcaucgagauggugcacgacggcgggaaggagacguggcacuccgccgccaccgccaucuacugccugaugggcagcgggcagcuccugugggacaccgugaccggcgucgacauggcgcuguga

SEQ ID NO: 90390 - RNA, 1401 nt, Artificial Sequence
  derived and/or modified sequence opt1 from neuraminidase__InfluenzaB__AGX19088
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucgugaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90391 - RNA, 1401 nt, Artificial Sequence; identical to SEQ ID NO: 89643
  derived and/or modified sequence opt1 from neuraminidase__InfluenzaB__AGX19099

SEQ ID NO: 90392 - RNA, 1401 nt, Artificial Sequence
  derived and/or modified sequence opt1 from neuraminidase__InfluenzaB__AGX19110
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggaucaagcacaccgaggagugcacgugcggcuucgccagcaacaagaccaucgagugcgcgugccgcgacaacuccuacaccgccaagcggcccuucaucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcugguguucuccggggucauggugagcauggaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcgugaacauggcccucuga

SEQ ID NO: 90393 - RNA, 1401 nt, Artificial Sequence
  derived and/or modified sequence opt1 from neuraminidase__InfluenzaB__AGX19121
augcugcccagcaccacccagacgcucacccuguuccugaccuccggcggggugcuccugagccuguacgucuccgccagccucuccuaccugcuguacagcgacauccuccugaaguucuccccgaccgagaucacggcccccaccaugccccuggacugcgcgaacgccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacgcgcggggaccggaacaagcugcgccaccucaucagcgugaagcugggcaagaucccgaccguggagaacuccaucuuccacauggccgccuggagcggguccgccugccacgacggcaaggaguggaccuacaucggcgucgacgggcccgacaacaacgcccugcucaagaucaaguacggcgaggcguacaccgacacguaccacagcuacgccaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgucaagcugaacguggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuuccgcggggugaugguguccaugaaggagccgggcugguacagcuucggguucgagaucaaggacaagaagugcgacguccccugcaucggcaucgagauggugcacgacggcgggaaggagacguggcacuccgccgccaccgccaucuacugccucaugggcagcgggcagcugcugugggacaccgugaccggcgucgacauggcgcucuga

SEQ ID NO: 90394 - RNA, 1401 nt, Artificial Sequence; identical to SEQ ID NO: 90277
  derived and/or modified sequence opt1 from neuraminidase__InfluenzaB__AGX19132

SEQ ID NO: 90395 - RNA, 1401 nt, Artificial Sequence; identical to SEQ ID NO: 90381
  derived and/or modified sequence opt1 from neuraminidase__InfluenzaB__AGX19143

SEQ ID NO: 90396 - RNA, 1401 nt, Artificial Sequence
  derived and/or modified sequence opt1 from neuraminidase__InfluenzaB__AGX19154
augcugcccagcaccauccagacccucacgcuguuccugaccuccggcggggugcuccugagccuguacgucuccgccagccucuccuaccugcuguacagcaacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90397 - RNA, 1401 nt, Artificial Sequence; identical to SEQ ID NO: 89643
  derived and/or modified sequence opt1 from neuraminidase__InfluenzaB__AGX19165

SEQ ID NO: 90398 - RNA, 1401 nt, Artificial Sequence
  derived and/or modified sequence opt1 from neuraminidase__InfluenzaB__AGX19176
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaaccgcacccggggcgaccgcaacaagcugcggcaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcgcacgcaggaguccgccugcaacugcaucggcgggaacugcuaccugaugaucaccgacggcagcgccagcggcguguccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacggcagcaucacggggcccugcgaguccaacggcgacaagggcagcgggggcaucaagggcggguucgugcaccagcggauggccuccaagaucgggcgcugguacagccggaccauguccaagaccgagcgcaugggcaugggccuguacgucaaguacgacggggaccccugggccgacagcgacgcgcuggccuucuccggcgugauggugagcaugaaggagccggggugguacuccuucggcuucgagaucaaggacaagaagugcgacguccccugcaucgggaucgagauggugcacgacggcggcaaggagaccuggcacagcgccgccacggccaucuacugccucaugggguccggccagcugcugugggacaccgugaccggggucgacauggcgcucuga

SEQ ID NO: 90399 - RNA, 1401 nt, Artificial Sequence
  derived and/or modified sequence opt1 from neuraminidase__InfluenzaB__AGX19187
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugcuccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacacgccccggccggacgacggguccaucaccggccccugcgagagcaacggcgacaagggguccggcgggaucaagggcggguucgugcaccagcgcauggccagcaagaucggccggugguacucccgcaccaugagcaagaccgagcggaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 90400 - RNA, 1401 nt, Artificial Sequence
  derived and/or modified sequence opt1 from neuraminidase__InfluenzaB__AGX19198
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacuacgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90401 - RNA, 1401 nt, Artificial Sequence; identical to SEQ ID NO: 90381
  derived and/or modified sequence opt1 from neuraminidase__InfluenzaB__AGX19209

SEQ ID NO: 90402 - RNA, 1401 nt, Artificial Sequence
  derived and/or modified sequence opt1 from neuraminidase__InfluenzaB__AGX19220
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaagaucaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacacgccccggccggacgacggguccaucaccggccccugcgagagcaacggcgaccgcggguccggcgggaucaagggcggguucgugcaccagcggauggccagcaagaucggccgcugguacucccggaccaugagcaagaccgagcgcaugggcauggggcuguacgucaaguacgacggcgaccccugggccgacuccgacgcgcuggccuucagcggggugaugguguccaugaaggagcccggcugguacagcuucggguucgagaucaaggacaagaagugcgacgucccgugcaucggcaucgagauggugcacgacggcgggaaggagaccuggcacuccgccgccacggccaucuacugccucaugggcagcgggcagcugcugugggacaccgugaccggcgucgacauggcgcucuga

SEQ ID NO: 90403 - RNA, 1401 nt, Artificial Sequence; identical to SEQ ID NO: 89849
  derived and/or modified sequence opt1 from neuraminidase__InfluenzaB__AGX19231

SEQ ID NO: 90404 - RNA, 1401 nt, Artificial Sequence
  derived and/or modified sequence opt1 from neuraminidase__InfluenzaB__AGX19253
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacucccuggcguucagcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 90405 - RNA, 1401 nt, Artificial Sequence; identical to SEQ ID NO: 90379
  derived and/or modified sequence opt1 from neuraminidase__InfluenzaB__AGX19264

SEQ ID NO: 90406 - RNA, 1401 nt, Artificial Sequence; identical to SEQ ID NO: 89643
  derived and/or modified sequence opt1 from neuraminidase__InfluenzaB__AGX19275

SEQ ID NO: 90407 - RNA, 1401 nt, Artificial Sequence
  derived and/or modified sequence opt1 from neuraminidase__InfluenzaB__AGX19286
augauccccagcaccauccagacccugacccucuuccugaccuccggcggggugcugcucagccuguacgucuccgccagccuguccuaccuccuguacagcgacauccugcucaaguucuccccgaccgagaucaucgcccccaccaugccccuggacugcgcgaacgccagcaacgugcacgccgugaaccgcuccgccacgaagggcgucacccugcuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagacgaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcucuacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcuccugugggacacggugaccggcgucgacauggcgcuguga

SEQ ID NO: 90408 - RNA, 1401 nt, Artificial Sequence
  derived and/or modified sequence opt1 from neuraminidase__InfluenzaB__AGX19297
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcacgccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90409 - RNA, 1401 nt, Artificial Sequence; identical to SEQ ID NO: 90408
  derived and/or modified sequence opt1 from neuraminidase__InfluenzaB__AGX19308

SEQ ID NO: 90410 - RNA, 1401 nt, Artificial Sequence; identical to SEQ ID NO: 90408
  derived and/or modified sequence opt1 from neuraminidase__InfluenzaB__AGX19319

SEQ ID NO: 90411 - RNA, 1401 nt, Artificial Sequence
  derived and/or modified sequence opt1 from neuraminidase__InfluenzaB__AGX19330
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcacgccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcgggaaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90412 - RNA, 1401 nt, Artificial Sequence; identical to SEQ ID NO: 90408
  derived and/or modified sequence opt1 from neuraminidase__InfluenzaB__AGX19341

SEQ ID NO: 90413 - RNA, 1401 nt, Artificial Sequence; identical to SEQ ID NO: 90408
  derived and/or modified sequence opt1 from neuraminidase__InfluenzaB__AGX19352

SEQ ID NO: 90414 - RNA, 1401 nt, Artificial Sequence
  derived and/or modified sequence opt1 from neuraminidase__InfluenzaB__AGX19363
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcacgccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugaccuacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90415 - RNA, 1401 nt, Artificial Sequence
  derived and/or modified sequence opt1 from neuraminidase__InfluenzaB__AGX19374
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugagcgagcccgaguggaccuacccccggcucuccugcccggggagcaccuuccagaaggcgcugcugaucagcccccaccgcuucggcgagaccaaggggaacuccgcgccccucaucauccgggagcccuucaucgccugcggcccgacggagugcaagcacuucgcccugacccacuacgccgcccagcccggcggguacuacaacggcacccgcgaggaccggaacaagcugcgccaccucaucuccgugaagcuggggaagauccccaccguggagaacagcaucuuccacauggccgccugguccggcagcgccugccacgacgggaaggaguggacguacaucggcgucgacggccccgacuccaacgcgcugcucaagaucaaguacggggaggccuacaccgacaccuaccacagcuacgccaagaacauccugcggacccaggagagcgccugcaacugcaucggcggggacugcuaccugaugaucacggacggcccggccuccggcgugagcgagugccgcuuccucaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgucaagcugaacguggagaccgacaccgccgagauccgccugaugugcacggagaccuaccucgacacgccccggccgaacgacggcuccaucaccgggcccugcgagagcgacggcgacaagggcuccgggggcaucaagggcggguucgugcaccagcgcauggccagcaagaucgggcggugguacucccgcaccaugagcaagaccaagcggaugggcaugggccuguacgucaaguacgacggggaccccuggaccgacuccgaggcgcuggcccucagcggcgugaugguguccauggaggagcccgggugguacagcuucggcuucgagaucaaggacaagaagugcgacgucccgugcaucgggaucgagauggugcacgacggcggcaagaccacguggcacuccgccgccaccgccaucuacugccugauggggagcggccagcugcucugggacaccgugaccggggucgacauggcgcuguga

SEQ ID NO: 90416 - RNA, 1401 nt, Artificial Sequence; identical to SEQ ID NO: 90408
  derived and/or modified sequence opt1 from neuraminidase__InfluenzaB__AGX19385

SEQ ID NO: 90417 - RNA, 1401 nt, Artificial Sequence
  derived and/or modified sequence opt1 from neuraminidase__InfluenzaB__AGX19396
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccaugccccuggacugcgcgaacgccagcaacgugcacgccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcccgcgcggggaccggaacaagcugcgccaccucaucagcgugaagcugggcaagauccccaccguggagaacuccaucuuccacauggccgccuggagcggguccgccugccacgacggcaaggaguggaccuacaucggcgucgacgggcccgacaacaacgcccugcucaagaucaaguacggcgaggcguacacggacaccuaccacagcuacgccaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccacggggcgggugaagcacaccgaggagugcacgugcggcuucgccagcaacaagaccaucgagugcgcgugccgcgacaacuccuacaccgccaagcggccguucgucaagcugaacguggagaccgacaccgccgagauccgccugaugugcaccgacacguaccucgacacgccccggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgacccgugggccgacagcgacgcgcuggccuucuccggggugauggugagcaugaaggagcccggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacaccgugacgggcgucgacauggcgcucuga

SEQ ID NO: 90418 - RNA, 1401 nt, Artificial Sequence; identical to SEQ ID NO: 90408
  derived and/or modified sequence opt1 from neuraminidase__InfluenzaB__AGX19407

SEQ ID NO: 90419 - RNA, 1401 nt, Artificial Sequence; identical to SEQ ID NO: 89969
  derived and/or modified sequence opt1 from neuraminidase__InfluenzaB__AGX19418

SEQ ID NO: 90420 - RNA, 1401 nt, Artificial Sequence
  derived and/or modified sequence opt1 from neuraminidase__InfluenzaB__AGX19429
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagacccggcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90421 - RNA, 1401 nt, Artificial Sequence
  derived and/or modified sequence opt1 from neuraminidase__InfluenzaB__AGX19451
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugauggugaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucguccaccagcggauggccuccaagaucggccgcugguacagccggaccauguccaagaccgagcgcaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90422 - RNA, 1401 nt, Artificial Sequence; identical to SEQ ID NO: 90420
  derived and/or modified sequence opt1 from neuraminidase__InfluenzaB__AGX19462

SEQ ID NO: 90423 - RNA, 1401 nt, Artificial Sequence; identical to SEQ ID NO: 90420
  derived and/or modified sequence opt1 from neuraminidase__InfluenzaB__AGX19473

SEQ ID NO: 90424 - RNA, 1401 nt, Artificial Sequence; identical to SEQ ID NO: 89969
  derived and/or modified sequence opt1 from neuraminidase__InfluenzaB__AGX19484

SEQ ID NO: 90425 - RNA, 1401 nt, Artificial Sequence; identical to SEQ ID NO: 90421
  derived and/or modified sequence opt1 from neuraminidase__InfluenzaB__AGX19495

SEQ ID NO: 90426 - RNA, 1401 nt, Artificial Sequence; identical to SEQ ID NO: 89969
  derived and/or modified sequence opt1 from neuraminidase__InfluenzaB__AGX19506

SEQ ID NO: 90427 - RNA, 1401 nt, Artificial Sequence; identical to SEQ ID NO: 89969
  derived and/or modified sequence opt1 from neuraminidase__InfluenzaB__AGX19517

SEQ ID NO: 90428 - RNA, 1401 nt, Artificial Sequence; identical to SEQ ID NO: 89969
  derived and/or modified sequence opt1 from neuraminidase__InfluenzaB__AGX19528

SEQ ID NO: 90429 - RNA, 1401 nt, Artificial Sequence; identical to SEQ ID NO: 90421
  derived and/or modified sequence opt1 from neuraminidase__InfluenzaB__AGX19539

SEQ ID NO: 90430 - RNA, 1401 nt, Artificial Sequence
  derived and/or modified sequence opt1 from neuraminidase__InfluenzaB__AGX19550
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugauggugaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucguccaccagcggauggccuccaagaucggccgcugguacagccggaccauguccaagaccgagcgcaugggcauggggcuguacgugaaguacgacggcgaccccugggccgacagcgacgcgcuggccuucuccggggugauggucagcaugaacgagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 90431 - RNA, 1401 nt, Artificial Sequence
  derived and/or modified sequence opt1 from neuraminidase__InfluenzaB__AGX19561
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagccccggggcuacuacaacgggacccgcggcgaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaagaucaaguacggggaggcguacaccgacaccuaccacagcuacgccaacaacauccugcggacgcaggaguccgccugcaacugcaucggcgggaacugcuaccugauggugaccgacggcagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacggcagcaucacggggcccugcgaguccaacggcgacaagggcagcgggggcaucaagggcggguucguccaccagcgcauggccuccaagaucgggcggugguacagccgcaccauguccaagaccgagcggaugggcaugggccuguacgugaaguacgacggggaccccugggccgacagcgacgcgcuggccuucuccggcgugauggucagcaugaaggagccggggugguacuccuucggcuucgagaucaaggacaagaagugcgacgugcccugcaucgggaucgagauggugcacgacggcggcaaggagaccuggcacagcgccgccacggccaucuacugccucaugggguccggccagcugcugugggacaccgucaccgggguggacauggcgcucuga

SEQ ID NO: 90432 - RNA, 1401 nt, Artificial Sequence
  derived and/or modified sequence opt1 from neuraminidase__InfluenzaB__AGX19572
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcgugaacauggcccucuga

SEQ ID NO: 90433 - RNA, 1401 nt, Artificial Sequence; identical to SEQ ID NO: 89969
  derived and/or modified sequence opt1 from neuraminidase__InfluenzaB__AGX19583

SEQ ID NO: 90434 - RNA, 1401 nt, Artificial Sequence; identical to SEQ ID NO: 89969
  derived and/or modified sequence opt1 from neuraminidase__InfluenzaB__AGX19594

SEQ ID NO: 90435 - RNA, 1401 nt, Artificial Sequence; identical to SEQ ID NO: 89969
  derived and/or modified sequence opt1 from neuraminidase__InfluenzaB__AGX19605

SEQ ID NO: 90436 - RNA, 1401 nt, Artificial Sequence; identical to SEQ ID NO: 89969
  derived and/or modified sequence opt1 from neuraminidase__InfluenzaB__AGX19616

SEQ ID NO: 90437 - RNA, 1401 nt, Artificial Sequence; identical to SEQ ID NO: 90421
  derived and/or modified sequence opt1 from neuraminidase__InfluenzaB__AGX19627

SEQ ID NO: 90438 - RNA, 1401 nt, Artificial Sequence; identical to SEQ ID NO: 89969
  derived and/or modified sequence opt1 from neuraminidase__InfluenzaB__AGX19638

SEQ ID NO: 90439 - RNA, 1401 nt, Artificial Sequence; identical to SEQ ID NO: 90421
  derived and/or modified sequence opt1 from neuraminidase__InfluenzaB__AGX19649

SEQ ID NO: 90440 - RNA, 1401 nt, Artificial Sequence; identical to SEQ ID NO: 90421
  derived and/or modified sequence opt1 from neuraminidase__InfluenzaB__AGX19660

SEQ ID NO: 90441 - RNA, 1401 nt, Artificial Sequence; identical to SEQ ID NO: 89969
  derived and/or modified sequence opt1 from neuraminidase__InfluenzaB__AGX19671

SEQ ID NO: 90442 - RNA, 1401 nt, Artificial Sequence; identical to SEQ ID NO: 89969
  derived and/or modified sequence opt1 from neuraminidase__InfluenzaB__AGX19682

SEQ ID NO: 90443 - RNA, 1401 nt, Artificial Sequence; identical to SEQ ID NO: 90421
  derived and/or modified sequence opt1 from neuraminidase__InfluenzaB__AGX19704

SEQ ID NO: 90444 - RNA, 1401 nt, Artificial Sequence
  derived and/or modified sequence opt1 from neuraminidase__InfluenzaB__AGX19715
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccaccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacguggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcccuggcguucuccggggugauggugagcaugaaggagccgggcugguacuccuucggguucgagaucaaggacaagaagugcgacguccccugcaucggcaucgagauggugcacgacggcgggaaggagacguggcacagcgccgccaccgccaucuacugccucaugggcuccgggcagcugcugugggacaccgugaccggcgucgacauggcccucuga

SEQ ID NO: 90445 - RNA, 1401 nt, Artificial Sequence; identical to SEQ ID NO: 89969
  derived and/or modified sequence opt1 from neuraminidase__InfluenzaB__AGX19726

SEQ ID NO: 90446 - RNA, 1401 nt, Artificial Sequence; identical to SEQ ID NO: 89969
  derived and/or modified sequence opt1 from neuraminidase__InfluenzaB__AGX19737

SEQ ID NO: 90447 - RNA, 1401 nt, Artificial Sequence; identical to SEQ ID NO: 89969
  derived and/or modified sequence opt1 from neuraminidase__InfluenzaB__AGX19748

SEQ ID NO: 90448 - RNA, 1401 nt, Artificial Sequence; identical to SEQ ID NO: 90421
  derived and/or modified sequence opt1 from neuraminidase__InfluenzaB__AGX19759

SEQ ID NO: 90449 - RNA, 1401 nt, Artificial Sequence; identical to SEQ ID NO: 89969
  derived and/or modified sequence opt1 from neuraminidase__InfluenzaB__AGX19770

SEQ ID NO: 90450 - RNA, 1401 nt, Artificial Sequence; identical to SEQ ID NO: 89969
  derived and/or modified sequence opt1 from neuraminidase__InfluenzaB__AGX19781

SEQ ID NO: 90451 - RNA, 1401 nt, Artificial Sequence; identical to SEQ ID NO: 89969
  derived and/or modified sequence opt1 from neuraminidase__InfluenzaB__AGX19792

SEQ ID NO: 90452 - RNA, 1401 nt, Artificial Sequence; identical to SEQ ID NO: 89969
  derived and/or modified sequence opt1 from neuraminidase__InfluenzaB__AGX19803

SEQ ID NO: 90453 - RNA, 1401 nt, Artificial Sequence; identical to SEQ ID NO: 89969
  derived and/or modified sequence opt1 from neuraminidase__InfluenzaB__AGX19814

SEQ ID NO: 90454 - RNA, 1401 nt, Artificial Sequence
  derived and/or modified sequence opt1 from neuraminidase__InfluenzaB__AGX19825
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcgcacgcaggaguccgccugcaacugcaucgggggcaacugcuaccugauggugaccgacggcagcgccagcgggguguccgagugccgguuccucaagauccgcgagggccggaucaucaaggagaucuuccccaccgggcgcgucaagcacaccgaggagugcacgugcggcuucgccaacaacaagaccaucgagugcgcgugccgggacaacagcuacaccgccaagcgccccuucgugaagcugaacguggagaccgacacggccgagauccggcugaugugcaccgacaccuaccucgacaccccgcgccccgacgacggguccaucacgggccccugcgagagcaacggcgacaagggguccggcgggaucaagggcggguucguccaccagcggauggccagcaagaucggccgcugguacucccggaccaugagcaagaccgagcgcaugggcauggggcuguacgugaaguacgacggcgaccccugggccgacuccgacgcgcuggccuucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcgcucuga

SEQ ID NO: 90455 - RNA, 1401 nt, Artificial Sequence; identical to SEQ ID NO: 89969
  derived and/or modified sequence opt1 from neuraminidase__InfluenzaB__AGX19836

SEQ ID NO: 90456 - RNA, 1401 nt, Artificial Sequence; identical to SEQ ID NO: 89969
  derived and/or modified sequence opt1 from neuraminidase__InfluenzaB__AGX19847

SEQ ID NO: 90457 - RNA, 1401 nt, Artificial Sequence; identical to SEQ ID NO: 89969
  derived and/or modified sequence opt1 from neuraminidase__InfluenzaB__AGX19858

SEQ ID NO: 90458 - RNA, 1401 nt, Artificial Sequence; identical to SEQ ID NO: 89969
  derived and/or modified sequence opt1 from neuraminidase__InfluenzaB__AGX19869

SEQ ID NO: 90459 - RNA, 1401 nt, Artificial Sequence; identical to SEQ ID NO: 89969
  derived and/or modified sequence opt1 from neuraminidase__InfluenzaB__AGX19880

SEQ ID NO: 90460 - RNA, 1401 nt, Artificial Sequence; identical to SEQ ID NO: 89969
  derived and/or modified sequence opt1 from neuraminidase__InfluenzaB__AGX19891

SEQ ID NO: 90461 - RNA, 1401 nt, Artificial Sequence; identical to SEQ ID NO: 89969
  derived and/or modified sequence opt1 from neuraminidase__InfluenzaB__AGX19902

SEQ ID NO: 90462 - RNA, 1401 nt, Artificial Sequence
  derived and/or modified sequence opt1 from neuraminidase__InfluenzaB__AGX19913
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccaugaaccacuccgccaccaagggcgugacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaacauccugcgcacgcaggaguccgccugcaacugcaucgggggcaacugcuaccugauggucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 90463 - RNA, 1401 nt, Artificial Sequence; identical to SEQ ID NO: 89969
  derived and/or modified sequence opt1 from neuraminidase__InfluenzaB__AGX19924

SEQ ID NO: 90464 - RNA, 1401 nt, Artificial Sequence; identical to SEQ ID NO: 89969
  derived and/or modified sequence opt1 from neuraminidase__InfluenzaB__AGX19935

SEQ ID NO: 90465 - RNA, 1401 nt, Artificial Sequence; identical to SEQ ID NO: 89969
  derived and/or modified sequence opt1 from neuraminidase__InfluenzaB__AGX19946

SEQ ID NO: 90466 - RNA, 1401 nt, Artificial Sequence; identical to SEQ ID NO: 89969
  derived and/or modified sequence opt1 from neuraminidase__InfluenzaB__AGX19957

SEQ ID NO: 90467 - RNA, 1401 nt, Artificial Sequence
  derived and/or modified sequence opt1 from neuraminidase__InfluenzaB__AGX19968
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcgugaacauggcccucuga

SEQ ID NO: 90468 - RNA, 1401 nt, Artificial Sequence; identical to SEQ ID NO: 90421
  derived and/or modified sequence opt1 from neuraminidase__InfluenzaB__AGX19979

SEQ ID NO: 90469 - RNA, 1401 nt, Artificial Sequence; identical to SEQ ID NO: 90421
  derived and/or modified sequence opt1 from neuraminidase__InfluenzaB__AGX19990

SEQ ID NO: 90470 - RNA, 1401 nt, Artificial Sequence; identical to SEQ ID NO: 89969
  derived and/or modified sequence opt1 from neuraminidase__InfluenzaB__AGX20001

SEQ ID NO: 90471 - RNA, 1401 nt, Artificial Sequence; identical to SEQ ID NO: 89969
  derived and/or modified sequence opt1 from neuraminidase__InfluenzaB__AGX20012

SEQ ID NO: 90472 - RNA, 1401 nt, Artificial Sequence; identical to SEQ ID NO: 89969
  derived and/or modified sequence opt1 from neuraminidase__InfluenzaB__AGX20023

SEQ ID NO: 90473 - RNA, 1401 nt, Artificial Sequence; identical to SEQ ID NO: 89969
  derived and/or modified sequence opt1 from neuraminidase__InfluenzaB__AGX20034

SEQ ID NO: 90474 - RNA, 1401 nt, Artificial Sequence; identical to SEQ ID NO: 89969
  derived and/or modified sequence opt1 from neuraminidase__InfluenzaB__AGX20045

SEQ ID NO: 90475 - RNA, 1401 nt, Artificial Sequence
  derived and/or modified sequence opt1 from neuraminidase__InfluenzaB__AGX20056
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaugauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccaacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggcguucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 90476 - RNA, 1401 nt, Artificial Sequence
  derived and/or modified sequence opt1 from neuraminidase__InfluenzaB__AGX20067
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccaacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggcguucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 90477 - RNA, 1401 nt, Artificial Sequence; identical to SEQ ID NO: 89969
  derived and/or modified sequence opt1 from neuraminidase__InfluenzaB__AGX20078

SEQ ID NO: 90478 - RNA, 1401 nt, Artificial Sequence; identical to SEQ ID NO: 89969
  derived and/or modified sequence opt1 from neuraminidase__InfluenzaB__AGX20089

SEQ ID NO: 90479 - RNA, 1401 nt, Artificial Sequence
  derived and/or modified sequence opt1 from neuraminidase__InfluenzaB__AGX20100
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgccgugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcggauccagcacaccgaggagugcacgugcggcuucgccagcaacaagaccaucgagugcgcgugccgcgacaacuccuacaccgccaagcggcccuucgucaagcucaacguggagaccgacacggccgagauccgccugaugugcaccaagaccuaccuggacaccccgcggcccgacgacgggagcaucacgggccccugcgaguccaacggcgggaagggcagcgggggcaucaagggcggguucgugcaccagcgcauggccuccaagaucggccggugguacagccgcaccauguccaagaccgagcggaaggggaugggccucuacgucaaguacgacggggaccccugggccgacagcgacgcgcuggccuucuccggcgugauggugagcauggaggagccggggugguacuccuucggcuucgagaucaaggacaagaagugcgacguccccugcaucggcaucgagauggugcacgacgggggcaaggagaccuggcacagcgccgccacggccaucuacugccugaugggguccggccagcuccugugggacaccgugaccggcgucaacauggcgcuguga

SEQ ID NO: 90480 - RNA, 1401 nt, Artificial Sequence
  derived and/or modified sequence opt1 from neuraminidase__InfluenzaB__AGX20111
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccugaccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90481 - RNA, 1401 nt, Artificial Sequence
  derived and/or modified sequence opt1 from neuraminidase__InfluenzaB__AGX20122
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgagaccaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90482 - RNA, 1401 nt, Artificial Sequence
  derived and/or modified sequence opt1 from neuraminidase__InfluenzaB__AGX20133
augcugcccagcaccauccagacccucacgcuguuccugaccuccggcggggugcuccugagccuguacgucuccgcccuccugagcuaccugcucuacuccgacgugcugcugaaguucagcccgaccgagaucaccgcccccacgaugucccucgacugcgcgaacgccagcaacgugcaggccgucaaccgcuccgccaccaagggcgugaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacggucgagaacuccaucuuccacauggccgccuggagcggguccgccugccacgacggcaaggaguggaccuacaucggcguggacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggcguucuccggggucauggugagcaugaaggagcccggcugguacuccuucggguucgagaucaaggacaagaagugcgacgugccgugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 90483 - RNA, 1401 nt, Artificial Sequence
  derived and/or modified sequence opt1 from neuraminidase__InfluenzaB__AGX20144
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccuggcguucuccggggugauggugagcaugaaggagcccggcugguacuccuucggguucgagaucaaggacaagaagugcgacgucccgugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 90484 - RNA, 1401 nt, Artificial Sequence; identical to SEQ ID NO: 90483
  derived and/or modified sequence opt1 from neuraminidase__InfluenzaB__AGX20155

SEQ ID NO: 90485 - RNA, 1401 nt, Artificial Sequence; identical to SEQ ID NO: 90483
  derived and/or modified sequence opt1 from neuraminidase__InfluenzaB__AGX20166

SEQ ID NO: 90486 - RNA, 1401 nt, Artificial Sequence; identical to SEQ ID NO: 89903
  derived and/or modified sequence opt1 from neuraminidase__InfluenzaB__AGX20177

SEQ ID NO: 90487 - RNA, 1401 nt, Artificial Sequence; identical to SEQ ID NO: 89903
  derived and/or modified sequence opt1 from neuraminidase__InfluenzaB__AGX20188

SEQ ID NO: 90488 - RNA, 1401 nt, Artificial Sequence; identical to SEQ ID NO: 89880
  derived and/or modified sequence opt1 from neuraminidase__InfluenzaB__AGX20199

SEQ ID NO: 90489 - RNA, 1401 nt, Artificial Sequence; identical to SEQ ID NO: 89903
  derived and/or modified sequence opt1 from neuraminidase__InfluenzaB__AGX20210

SEQ ID NO: 90490 - RNA, 1401 nt, Artificial Sequence; identical to SEQ ID NO: 90483
  derived and/or modified sequence opt1 from neuraminidase__InfluenzaB__AGX20221

SEQ ID NO: 90491 - RNA, 1401 nt, Artificial Sequence
  derived and/or modified sequence opt1 from neuraminidase__InfluenzaB__AGX20232
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccuggacugcgcgaacgccagcaacgugcaggccgugaaccgcuccgccaccaagggggucaccuuccuccugcccgagccggaguggaccuacccccggcugagcugccccggcuccacguuccagaaggcccuccugaucagcccccaccgcuucggggagaccaagggcaacuccgcgccgcugaucauccgggagcccuucaucgccugcggccccaacgagugcaagcacuucgcccucacccacuacgccgcgcagcccgggggcuacuacaacgggacccgcggcgaccggaacaagcugcgccaccugaucagcgugaagcucgggaagaucccgacgguggagaacuccaucuuccacauggccgccuggagcggcuccgccugccacgacggcaaggaguggaccuacaucggggucgacggccccgacaacaacgcccugcugaaggugaaguacggggaggcguacaccgacaccuaccacagcuacgccaacaagauccuccggacgcaggaguccgccugcaacugcaucggcggcaacugcuaccugaugaucaccgacgggagcgccagcggcguguccgagugccgcuuccugaagauccgggaggggcgcaucaucaaggagaucuuccccaccggccgggucaagcacaccgaggagugcacgugcggguucgccagcaacgagaccaucgagugcgcgugccgcgacaacuccuacaccgccaagcggcccuucgugaagcucaacguggagaccgacacggccgagauccgccugaugugcaccgacaccuaccuggacaccccgcggcccaacgacggcagcaucacgggccccugcgaguccaacggggacaagggcgggggcgggaucaagggcggcuucguccaccagcgcauggagagcaagaucgggcggugguacucccgcaccaugagcaagaccgagcggaugggcauggggcucuacgugaaguacgacggcgaccccugggccgacuccgacgcccuggcguucagcggggugauggucuccaugaaggagccgggcugguacagcuucggcuucgagaucaaggacaagaagugcgacgugcccugcaucgggaucgagauggugcacgacggcgggaaggagaccuggcacuccgccgccacggccaucuacugccugaugggcagcggccagcuccugugggacaccgucaccgggguggacauggcccuguga

SEQ ID NO: 90492 - RNA, 1401 nt, Artificial Sequence; identical to SEQ ID NO: 89903
  derived and/or modified sequence opt1 from neuraminidase__InfluenzaB__AGX20243

SEQ ID NO: 90493 - RNA, 1401 nt, Artificial Sequence; identical to SEQ ID NO: 90483
  derived and/or modified sequence opt1 from neuraminidase__InfluenzaB__AGX20254

SEQ ID NO: 90494 - RNA, 1401 nt, Artificial Sequence; identical to SEQ ID NO: 89880
  derived and/or modified sequence opt1 from neuraminidase__InfluenzaB__AGX20265

SEQ ID NO: 90495 - RNA, 1401 nt, Artificial Sequence; identical to SEQ ID NO: 90483
  derived and/or modified sequence opt1 from neuraminidase__InfluenzaB__AGX20276

SEQ ID NO: 90496 - RNA, 1401 nt, Artificial Sequence; identical to SEQ ID NO: 89903
  derived and/or modified sequence opt1 from neuraminidase__InfluenzaB__AGX20287

SEQ ID NO: 90497 - RNA, 1401 nt, Artificial Sequence
  derived and/or modified sequence opt1 from neuraminidase__InfluenzaB__AGX20298
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcagagcgccgccacggccaucuacugccucaugggcuccgggcagcugcugugggacaccgucaccggcguggacauggcccucuga

SEQ ID NO: 90498 - RNA, 1401 nt, Artificial Sequence; identical to SEQ ID NO: 89880
  derived and/or modified sequence opt1 from neuraminidase__InfluenzaB__AGX20320

SEQ ID NO: 90499 - RNA, 1401 nt, Artificial Sequence; identical to SEQ ID NO: 89903
  derived and/or modified sequence opt1 from neuraminidase__InfluenzaB__AGX20331

SEQ ID NO: 90500 - RNA, 1401 nt, Artificial Sequence
  derived and/or modified sequence opt1 from neuraminidase__InfluenzaB__AGX20342
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggcguucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 90501 - RNA, 1401 nt, Artificial Sequence
  derived and/or modified sequence opt1 from neuraminidase__InfluenzaB__AGX20353
augcugcccagcaccauccagacccucacgcuguuccugaccuccggcggggugcuccugagccuguacgucuccgcccuccugagcuaccugcucuacuccgacauccugcugaaguucagcccgaccgagaucaucgcccccaccaugucccucgacugcgcgaacgccagcaacgugcaggccgugaaccgcuccgccacgaagggcgucaccuuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaacgagugcaagcacuucgcccugacccacuacgccgcgcagcccggcggguacuacaaccgcacccggggcgaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacaacgacgcccugcucaaggugaaguacggggaggcguacaccgacaccuaccacagcuacgccaacaagauccugcgcacccaggaguccgccugcaacugcaucggcgggaacugcuaccugaugaucacggacggcagcgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcugaacguggagaccgacaccgccgagauccggcugaugugcacggacaccuaccucgacacgccccgcccggacgacggcagcaucaccgggcccugcgaguccaacggcgacaagggcagcgggggcaucaagggcggguucgugcaccagcggauggaguccaagaucgggcgcugguacagccggaccauguccaagaccgagcgcaugggcaugggccuguacgucaaguacgacggggaccccugggccgacagcgacgcccuggcguucuccggcgugauggugagcaugaaggagcccgggugguacuccuucggcuucgagaucaaggacaagaagugcgacgucccgugcaucgggaucgagauggugcacgacggcggcaaggagaccuggcacagcgccgccaccgccaucuacugccucaugggguccggccagcugcugugggacacggugaccggggucgacauggcccucuga

SEQ ID NO: 90502 - RNA, 1401 nt, Artificial Sequence; identical to SEQ ID NO: 89903
  derived and/or modified sequence opt1 from neuraminidase__InfluenzaB__AGX20364

SEQ ID NO: 90503 - RNA, 1401 nt, Artificial Sequence; identical to SEQ ID NO: 89898
  derived and/or modified sequence opt1 from neuraminidase__InfluenzaB__AGX20375

SEQ ID NO: 90504 - RNA, 1401 nt, Artificial Sequence
  derived and/or modified sequence opt1 from neuraminidase__InfluenzaB__AGX20386
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggacccacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccuggcguucuccggggugauggugagcaugaaggagcccggcugguacuccuucggguucgagaucaaggacaagaagugcgacgucccgugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 90505 - RNA, 1401 nt, Artificial Sequence; identical to SEQ ID NO: 89903
  derived and/or modified sequence opt1 from neuraminidase__InfluenzaB__AGX20397

SEQ ID NO: 90506 - RNA, 1401 nt, Artificial Sequence; identical to SEQ ID NO: 89898
  derived and/or modified sequence opt1 from neuraminidase__InfluenzaB__AGX20408

SEQ ID NO: 90507 - RNA, 1401 nt, Artificial Sequence; identical to SEQ ID NO: 89880
  derived and/or modified sequence opt1 from neuraminidase__InfluenzaB__AGX20419

SEQ ID NO: 90508 - RNA, 1401 nt, Artificial Sequence
  derived and/or modified sequence opt1 from neuraminidase__InfluenzaB__AGX20430
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgaggcgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcugaugugcacggacaccuaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcgcuggccuucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 90509 - RNA, 1401 nt, Artificial Sequence; identical to SEQ ID NO: 89880
  derived and/or modified sequence opt1 from neuraminidase__InfluenzaB__AGX20441

SEQ ID NO: 90510 - RNA, 1401 nt, Artificial Sequence
  derived and/or modified sequence opt1 from neuraminidase__InfluenzaB__AGX20452
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucaccuuccuccugcccgagcccgaguggaccuacccgcggcuguccugccccgggagcacguuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucuccgugaagcucggcaagauccccacgguggagaacagcaucuuccacauggccgccugguccgggagcgccugccacgacggcaaggaguggaccuacaucggcgucgacgggccggacaacgacgcccugcugaaggugaaguacggcgaggcguacaccgacaccuaccacuccuacgccaacaagauccuccggacgcaggagagcgccugcaacugcaucgggggcaacugcuaccugaugaucaccgacggcagcgccuccggggugagcgagugccgcuuccugaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcucaacguggagaccgacacggccgagauccgccugaugugcaccgacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagauccgcgacaagaagugcgacgugccgugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 90511 - RNA, 1401 nt, Artificial Sequence; identical to SEQ ID NO: 89903
  derived and/or modified sequence opt1 from neuraminidase__InfluenzaB__AGX20463

SEQ ID NO: 90512 - RNA, 1401 nt, Artificial Sequence; identical to SEQ ID NO: 89903
  derived and/or modified sequence opt1 from neuraminidase__InfluenzaB__AGX20474

SEQ ID NO: 90513 - RNA, 1401 nt, Artificial Sequence; identical to SEQ ID NO: 89903
  derived and/or modified sequence opt1 from neuraminidase__InfluenzaB__AGX20485

SEQ ID NO: 90514 - RNA, 1401 nt, Artificial Sequence; identical to SEQ ID NO: 90483
  derived and/or modified sequence opt1 from neuraminidase__InfluenzaB__AGX20496

SEQ ID NO: 90515 - RNA, 1401 nt, Artificial Sequence; identical to SEQ ID NO: 89903
  derived and/or modified sequence opt1 from neuraminidase__InfluenzaB__AGX20507

SEQ ID NO: 90516 - RNA, 1401 nt, Artificial Sequence; identical to SEQ ID NO: 89903
  derived and/or modified sequence opt1 from neuraminidase__InfluenzaB__AGX20518

SEQ ID NO: 90517 - RNA, 1401 nt, Artificial Sequence
  derived and/or modified sequence opt1 from neuraminidase__InfluenzaB__AGX20529
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcacgugccgcgacaacuccuacaccgcgaagcggcccuucgugaagcugaacguggagaccgacaccgccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggccuucuccggggugauggucagcaugaaggagcccggcugguacuccuucggguucgagaucaaggacaagaagugcgacgugccgugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90518 - RNA, 1401 nt, Artificial Sequence; identical to SEQ ID NO: 90481
  derived and/or modified sequence opt1 from neuraminidase__InfluenzaB__AGX20540

SEQ ID NO: 90519 - RNA, 1401 nt, Artificial Sequence; identical to SEQ ID NO: 90127
  derived and/or modified sequence opt1 from neuraminidase__InfluenzaB__AGX20551

SEQ ID NO: 90520 - RNA, 1401 nt, Artificial Sequence; identical to SEQ ID NO: 89880
  derived and/or modified sequence opt1 from neuraminidase__InfluenzaB__AGX20562

SEQ ID NO: 90521 - RNA, 1401 nt, Artificial Sequence; identical to SEQ ID NO: 89903
  derived and/or modified sequence opt1 from neuraminidase__InfluenzaB__AGX20573

SEQ ID NO: 90522 - RNA, 1401 nt, Artificial Sequence
  derived and/or modified sequence opt1 from neuraminidase__InfluenzaB__AGX20584
augcugcccagcaccauccagacccucacgcuguuccugaccuccggcggggugcuccugagccuguacgucuccgccagccucuccuaccugcuguacagcgacauccuccugaaguucuccagcaccgagaucaccgccccgacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaaggugaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcugaacguggagaccgacacggccgagauccgccugaugugcaccgacaccuaccucgacacgccccggccgaacgacggguccaucaccggccccugcgagagcaacggcgacaagggguccggcgggaucaagggcggguucguccaccagcgcauggagagccggaucggccgcugguacucccggaccaugagcaagaccgagcgcaugggcauggggcuguacgugaaguacgacggcgaccccuggaccgacuccgacgcccugacguucagcggggugauggucuccaugaaggagcccggcugguacagcuucggguucgagaucaaggacaagaagugcgacgugccgugcaucggcaucgagauggugcacgacggcgggaaggagaccuggcacuccgccgcgaccgccaucuacugccucaugggcagcgggcagcugcugugggacaccgucacgggcguggacauggcccucuga

SEQ ID NO: 90523 - RNA, 1401 nt, Artificial Sequence; identical to SEQ ID NO: 89903
  derived and/or modified sequence opt1 from neuraminidase__InfluenzaB__AGX20595

SEQ ID NO: 90524 - RNA, 1401 nt, Artificial Sequence; identical to SEQ ID NO: 90481
  derived and/or modified sequence opt1 from neuraminidase__InfluenzaB__AGX20606

SEQ ID NO: 90525 - RNA, 1401 nt, Artificial Sequence; identical to SEQ ID NO: 90481
  derived and/or modified sequence opt1 from neuraminidase__InfluenzaB__AGX20617

SEQ ID NO: 90526 - RNA, 1401 nt, Artificial Sequence; identical to SEQ ID NO: 90508
  derived and/or modified sequence opt1 from neuraminidase__InfluenzaB__AGX20628

SEQ ID NO: 90527 - RNA, 1401 nt, Artificial Sequence; identical to SEQ ID NO: 89908
  derived and/or modified sequence opt1 from neuraminidase__InfluenzaB__AGX20639

SEQ ID NO: 90528 - RNA, 1401 nt, Artificial Sequence
  derived and/or modified sequence opt1 from neuraminidase__InfluenzaB__AGX20650
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccacgugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgccugccgcgacaacuccuacaccgcgaagcggcccuucgugaagcugaacguggagaccgacaccgccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggccuucuccggggugauggucagcaugaaggagcccggcugguacuccuucggguucgagaucaaggacaagaagugcgacgugccgugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90529 - RNA, 1401 nt, Artificial Sequence
  derived and/or modified sequence opt1 from neuraminidase__InfluenzaB__AGX20661
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaaccugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccuggaccgacagcgacgcccuggccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 90530 - RNA, 1401 nt, Artificial Sequence; identical to SEQ ID NO: 89964
  derived and/or modified sequence opt1 from neuraminidase__InfluenzaB__AGX20683

SEQ ID NO: 90531 - RNA, 1401 nt, Artificial Sequence; identical to SEQ ID NO: 90127
  derived and/or modified sequence opt1 from neuraminidase__InfluenzaB__AGX20694

SEQ ID NO: 90532 - RNA, 1401 nt, Artificial Sequence
  derived and/or modified sequence opt1 from neuraminidase__InfluenzaB__AGX20705
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccuggacugcgcgaacgccagcgacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaaggugaaguacggggaggcguacaccgacaccuaccacagcuacgccaacaagauccugcggacgcaggaguccgccugcaacugcaucggcggcaacugcuaccugaugaucaccgacgggagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacggcagcaucacgggccccugcgaguccaacggggacaagggcagcgggggcaucaagggcggguucguccaccagcgcauggaguccaagaucggccggugguacagccgcaccauguccaagaccgagcggauggggaugggccuguacgugaaguacgacggggaccccugggccgacagcgacgcccugaccuucuccggcgugauggucagcaugaaggagccggggugguacuccuucggcuucgagaucaaggacaagaagugcgacgugcccugcaucggcaucgagauggugcacgacgggggcaaggagacguggcacagcgcggccaccgccaucuacugccucaugggguccggccagcugcugugggacaccgucaccggcguggacauggcccucuga

SEQ ID NO: 90533 - RNA, 1401 nt, Artificial Sequence
  derived and/or modified sequence opt1 from neuraminidase__InfluenzaB__AGX20716
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcaucgagucccggaucggccgcugguacagccggaccauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90534 - RNA, 1401 nt, Artificial Sequence
  derived and/or modified sequence opt1 from neuraminidase__InfluenzaB__AGX20727
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaccaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagacguggcacagcgccgccaccgccaucuacugccucaugggcuccgggcagcugcugugggacaccgucaccggcguggacauggcccucuga

SEQ ID NO: 90535 - RNA, 1401 nt, Artificial Sequence; identical to SEQ ID NO: 90127
  derived and/or modified sequence opt1 from neuraminidase__InfluenzaB__AGX20738

SEQ ID NO: 90536 - RNA, 1401 nt, Artificial Sequence; identical to SEQ ID NO: 89903
  derived and/or modified sequence opt1 from neuraminidase__InfluenzaB__AGX20749

SEQ ID NO: 90537 - RNA, 1401 nt, Artificial Sequence
  derived and/or modified sequence opt1 from neuraminidase__InfluenzaB__AGX20760
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggagucccggaucggccgcugguacagccggaccauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90538 - RNA, 1401 nt, Artificial Sequence; identical to SEQ ID NO: 89903
  derived and/or modified sequence opt1 from neuraminidase__InfluenzaB__AGX20771

SEQ ID NO: 90539 - RNA, 1401 nt, Artificial Sequence
  derived and/or modified sequence opt1 from neuraminidase__InfluenzaB__AGX20782
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcucccaccgguucggcgagaccaaggggaacagcgcgccccucaucauccgcgagccguucguggccugcggccccaacgagugcaagcacuucgcccugacccacuacgccgcgcagcccggcggguacuacaacggcacccgcggggaccggaacaagcugcggcaccucaucuccgugaagcugggcaagauccccacggucgagaacagcaucuuccacauggccgccugguccgggagcgccugccacgacggcaaggaguggaccuacaucggcguggacgggccggacaacaacgcccugcucaaggugaaguacggcgaggcguacaccgacaccuaccacuccuacgccaacaagauccugcgcacgcaggagagcgccugcaacugcaucgggggcaacugcuaccugaugaucaccgacggcagcgccuccggggucagcgagugccgguuccucaagauccgcgagggccggaucaucaaggagaucuuccccaccgggcgcgugaagcacaccgaggagugcacgugcggcuucgccuccaacaagaccaucgagugcgcgugccgggacaacagcuacaccgccaagcgccccuucgugaagcugaacgucgagaccgacacggccgagauccggcugaugugcaccgacaccuaccucgacacgccccgcccgaacgacggguccaucaccggccccugcgagagcgacggcgacaagggguccggcgggaucaagggcggguucgugcaccagcggauggagagcaagaucggccgcugguacucccggaccaugagccgcaccgagcggaugggcauggggcuguacgugaaguacgacggcgaccccugggccgacuccgacgcccuggcguucagcggggucaugguguccaugaaggagcccggcugguacagcuucggguucgagaucaaggacaagaagugcgacgugccgugcaucggcaucgagaugguccacgacggcgggaaggagaccuggcacuccgccgccacggccaucuacugccucaugggcagcgggcagcugcugugggacaccgugaccggcguggacauggcccucuga

SEQ ID NO: 90540 - RNA, 1401 nt, Artificial Sequence
  derived and/or modified sequence opt1 from neuraminidase__InfluenzaB__AGX20793
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacaccagcaacgugcaggccgugaaccgcuccgccaccaagggcgucaccuuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaacgagugcaagcacuucgcccugacccacuacgccgcccagcccggcggguacuacaacggcacgcgcggggaccggaacaagcugcgccaccucaucagcgugaagcugggcaagauccccaccguggagaacuccaucuuccacauggcggccuggagcggguccgccugccacgacggcaaggaguggaccuacaucggcgucgacgggccggacaacgacgcccugcucaaggugaaguacggcgaggccuacaccgacacguaccacagcuacgcgaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacacggaggagugcacgugcggcuucgccagcaacaagaccaucgagugcgccugccgcgacaacuccuacaccgcgaagcggcccuucgugaagcugaacguggagaccgacaccgccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggccuucuccggggugauggucagcaugaaggagcccggcugguacuccuucggguucgagaucaaggacaagaagugcgacgugccgugcaucggcaucgagauggugcacgacggcgggaaggagacguggcacagcgcggccaccgccaucuacugccucaugggcuccgggcagcugcugugggacaccgucaccggcgugaacauggcccucuga

SEQ ID NO: 90541 - RNA, 1401 nt, Artificial Sequence
  derived and/or modified sequence opt1 from neuraminidase__InfluenzaB__AGX20804
augcugcccagcaccauccagacccucacgcuguucaucaccuccggcggggugcugcucagccuguacgucuccgcccugcucagcuaccugcuguacuccgacauccuccugaaguucagcccgaccgagaucaccgcccccacgaugucccuggacugcgcgaacgccagcaacgugcaggccgugaaccgcuccgccaccaagggcgucaccuuccuccugcccgagcccgaguggaccuacccgcggcugagcugccccggguccacguuccagaaggcccuccugaucagcccccaccgcuucggcgagaccaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggccggacaacgacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcucuacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccugaugggcuccgggcagcuccugugggacaccgucaccggcguggacauggcccuguga

SEQ ID NO: 90542 - RNA, 1401 nt, Artificial Sequence; identical to SEQ ID NO: 89964
  derived and/or modified sequence opt1 from neuraminidase__InfluenzaB__AGX20815

SEQ ID NO: 90543 - RNA, 1401 nt, Artificial Sequence; identical to SEQ ID NO: 89964
  derived and/or modified sequence opt1 from neuraminidase__InfluenzaB__AGX20826

SEQ ID NO: 90544 - RNA, 1401 nt, Artificial Sequence; identical to SEQ ID NO: 89964
  derived and/or modified sequence opt1 from neuraminidase__InfluenzaB__AGX20837

SEQ ID NO: 90545 - RNA, 1401 nt, Artificial Sequence; identical to SEQ ID NO: 89964
  derived and/or modified sequence opt1 from neuraminidase__InfluenzaB__AGX20848

SEQ ID NO: 90546 - RNA, 1401 nt, Artificial Sequence
  derived and/or modified sequence opt1 from neuraminidase__InfluenzaB__AGX20870
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgagcccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 90547 - RNA, 1401 nt, Artificial Sequence
  derived and/or modified sequence opt1 from neuraminidase__InfluenzaB__AGX20881
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcgggaaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 90548 - RNA, 1401 nt, Artificial Sequence
  derived and/or modified sequence opt1 from neuraminidase__InfluenzaB__AGX20892
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgaggcgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagauccugcccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcucaugugcacggacaccuaccuggacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcgcucgccuucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccugaugggcuccgggcagcugcucugggacacggucaccggcguggacauggcgcuguga

SEQ ID NO: 90549 - RNA, 1401 nt, Artificial Sequence; identical to SEQ ID NO: 89964
  derived and/or modified sequence opt1 from neuraminidase__InfluenzaB__AGX20903

SEQ ID NO: 90550 - RNA, 1401 nt, Artificial Sequence; identical to SEQ ID NO: 89964
  derived and/or modified sequence opt1 from neuraminidase__InfluenzaB__AGX20914

SEQ ID NO: 90551 - RNA, 1401 nt, Artificial Sequence
  derived and/or modified sequence opt1 from neuraminidase__InfluenzaB__AGX20925
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccaggagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90552 - RNA, 1401 nt, Artificial Sequence
  derived and/or modified sequence opt1 from neuraminidase__InfluenzaB__AGX20936
augcugcccagcaccauccagacccucacgcuguuccugaccuccggcggggugcuccugagccuguacgucuccgcccuccugagcuaccugcucuacuccgacauccugccgaaguucagccccaccgagaucaccgcccccacgaugucccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacgacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcucuacgugaaguacgacggcgaccccugggccgacagcgacgcccugguguucuccggggucauggugagcaugaaggagccgggcugguacuccuucggguucgagaucaaggacaagaagugcgacgugcccugcaucggcaucgagaugguccacgacggcgggaaggagaccuggcacagcgcggccacggccaucuacugccugaugggcuccgggcagcuccugugggacaccgugaccggcguggacauggcccuguga

SEQ ID NO: 90553 - RNA, 1401 nt, Artificial Sequence; identical to SEQ ID NO: 89903
  derived and/or modified sequence opt1 from neuraminidase__InfluenzaB__AGX20947

SEQ ID NO: 90554 - RNA, 1401 nt, Artificial Sequence
  derived and/or modified sequence opt1 from neuraminidase__InfluenzaB__AGX20958
augcugcccagcaccauccagacccucacgcuguuccugaccuccggcggggugcuccugagccuguacgucuccgcccuccugagcuaccugcucuacuccgacauccugcugaaguucagcccgaccgagaucaccacgcccaccaugucccucgacugcaccaacgccagcaacgugcaggcggugaaccgcuccgccaccaagggcgucacguuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccaacgagugcaagcacuucgcccugacgcacuacgccgcccagcccggcggguacuacaacggcacccgcggggaccggaacaagcugcgccaccucaucagcgugaagcugggcaagauccccaccguggagaacuccaucuuccacauggccgcguggagcggguccgccugccacgacggcaaggaguggaccuacaucggcgucgacgggccggacaacgacgcccugcucaaggugaaguacggcgaggccuacacggacaccuaccacagcuacgccaacaagauccugcggacccaggaguccgcgugcaacugcaucgggggcaacugcuaccugaugaucaccgacggcagcgccagcgggguguccgagugccgcuuccucaagauccaggagggccggaucaucaaggagaucuuccccacggggcgcgucaagcacaccgaggagugcacgugcggcuucgccagcaacaagaccaucgagugcgccugccgggacaacuccuacaccgccaagcgccccuucgugaagcugaacguggagaccgacaccgcggagauccggcugaugugcaccgacacguaccucgacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggccuucuccggggugauggucagcaugaaggagcccggcugguacuccuucggguucgagaucaaggacaagaagugcgacgugccgugcaucggcaucgagauggugcacgacggcgggaaggagaccuggcacagcgccgcgaccgccaucuacugccucaugggcuccgggcagcugcugugggacaccgucacgggcguggacauggcccucuga

SEQ ID NO: 90555 - RNA, 1401 nt, Artificial Sequence; identical to SEQ ID NO: 90127
  derived and/or modified sequence opt1 from neuraminidase__InfluenzaB__AGX20969

SEQ ID NO: 90556 - RNA, 1401 nt, Artificial Sequence; identical to SEQ ID NO: 90540
  derived and/or modified sequence opt1 from neuraminidase__InfluenzaB__AGX20980

SEQ ID NO: 90557 - RNA, 1401 nt, Artificial Sequence
  derived and/or modified sequence opt1 from neuraminidase__InfluenzaB__AGX20991
augcugcccagcaccauccagacccucacgcuguuccugaccuccggcggggugcuccugagccuguacgucuccgcccuccugagcuaccugcucuacuccgacauccugccgaaguucagccccaccgagaucaccgcccccacgaugucccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacgacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccggaagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcucuacgugaaguacgacggcgaccccugggccgacagcgacgcccugguguucuccggggucauggugagcaugaaggagccgggcugguacuccuucggguucgagaucaaggacaagaagugcgacgugcccugcaucggcaucgagaugguccacgacggcgggaaggagaccuggcacagcgcggccacggccaucuacugccugaugggcuccgggcagcuccugugggacaccgugaccggcguggacauggcccuguga

SEQ ID NO: 90558 - RNA, 1401 nt, Artificial Sequence; identical to SEQ ID NO: 89964
  derived and/or modified sequence opt1 from neuraminidase__InfluenzaB__AGX21002

SEQ ID NO: 90559 - RNA, 1401 nt, Artificial Sequence
  derived and/or modified sequence opt1 from neuraminidase__InfluenzaB__AGX21013
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccaacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90560 - RNA, 1401 nt, Artificial Sequence
  derived and/or modified sequence opt1 from neuraminidase__InfluenzaB__AGX21024
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagccccaaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagguccgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccugaccuucuccggggucauggugagcaugaaggagccgggcugguacuccuucggguucgagaucaaggacaagaagugcgacgugcccugcaucggcaucgagaugguccacgacggcgggaaggagacguggcacagcgcggccaccgccaucuacugccucaugggcuccgggcagcugcugugggacaccgugaccggcguggacauggcccucuga

SEQ ID NO: 90561 - RNA, 1401 nt, Artificial Sequence; identical to SEQ ID NO: 89964
  derived and/or modified sequence opt1 from neuraminidase__InfluenzaB__AGX21035

SEQ ID NO: 90562 - RNA, 1401 nt, Artificial Sequence; identical to SEQ ID NO: 90127
  derived and/or modified sequence opt1 from neuraminidase__InfluenzaB__AGX21046

SEQ ID NO: 90563 - RNA, 1401 nt, Artificial Sequence; identical to SEQ ID NO: 90130
  derived and/or modified sequence opt1 from neuraminidase__InfluenzaB__AGX21057

SEQ ID NO: 90564 - RNA, 1401 nt, Artificial Sequence; identical to SEQ ID NO: 90548
  derived and/or modified sequence opt1 from neuraminidase__InfluenzaB__AGX21068

SEQ ID NO: 90565 - RNA, 1401 nt, Artificial Sequence
  derived and/or modified sequence opt1 from neuraminidase__InfluenzaB__AGX21079
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccuccaagauccugcggacccaggagagcgccugcaacugcaucgggggcaacugcuaccugaugaucacggacggcagcgccuccggggugagcgagugccgcuuccucaagauccgggagggccgcaucaucaaggagaucuuccccaccgggcgggucaagcacaccgaggagugcacgugcggcuucgcguccaacaagaccaucgagugcgccugccgcgacaacagcuacaccgccaagcggcccuucgugaagcugaacguggagaccgacaccgccgagauccgccugaugugcacggacaccuaccucgacaccccgcggcccaacgacggguccaucaccggccccugcgagagcgacggcgacaagggguccggcgggaucaagggcggguucguccaccagcgcauggagagcaagaucggccggugguacucccgcacgaugagcaagaccgagcggaugggcauggggcuguacgugaaguacgacggcgaccccugggccgacuccgacgcgcuggccuucagcggggugauggucuccaugaaggagccgggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcgcucuga

SEQ ID NO: 90566 - RNA, 1401 nt, Artificial Sequence; identical to SEQ ID NO: 90130
  derived and/or modified sequence opt1 from neuraminidase__InfluenzaB__AGX21088

SEQ ID NO: 90567 - RNA, 1401 nt, Artificial Sequence; identical to SEQ ID NO: 90130
  derived and/or modified sequence opt1 from neuraminidase__InfluenzaB__AGX21099

SEQ ID NO: 90568 - RNA, 1401 nt, Artificial Sequence
  derived and/or modified sequence opt1 from neuraminidase__InfluenzaB__AGX21110
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuucgccaccaagggcgucaccuuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacgacgcccugcucaaggugaaguacggcgaggcguacaccgacaccuaccacuccuacgccaacaagauccugcggacgcaggagagcgccugcaacugcaucgggggcaacugcuaccugaugaucaccgacggcuccgccagcggggugagcgagugccgcuuccucaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcugaacguggagaccgacacggccgagauccgccugaugugcaccgacaccuaccucgacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcuguacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 90569 - RNA, 1401 nt, Artificial Sequence
  derived and/or modified sequence opt1 from neuraminidase__InfluenzaB__AGX21121
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaccaaggagaucuuccccaccgggcgggucaagcacacggaggagugcacgugcggcuucgccagcaacaagaccaucgagugcgcgugccgcgacaacuccuacaccgccaagcggcccuucgugaagcugaacguggagaccgacaccgccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagacguggcacagcgccgccaccgccaucuacugccucaugggcuccgggcagcugcugugggacaccgucaccggcguggacauggcccucuga

SEQ ID NO: 90570 - RNA, 1401 nt, Artificial Sequence; identical to SEQ ID NO: 90127
  derived and/or modified sequence opt1 from neuraminidase__InfluenzaB__AGX21132

SEQ ID NO: 90571 - RNA, 1401 nt, Artificial Sequence; identical to SEQ ID NO: 89903
  derived and/or modified sequence opt1 from neuraminidase__InfluenzaB__AGX21143

SEQ ID NO: 90572 - RNA, 1401 nt, Artificial Sequence; identical to SEQ ID NO: 89964
  derived and/or modified sequence opt1 from neuraminidase__InfluenzaB__AGX21154

SEQ ID NO: 90573 - RNA, 1401 nt, Artificial Sequence
  derived and/or modified sequence opt1 from neuraminidase__InfluenzaB__AGX21165
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacauggagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccuggcguucuccggggugauggugagcaugaaggagcccggcugguacuccuucggguucgagaucaaggacaagaagugcgacgucccgugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 90574 - RNA, 1401 nt, Artificial Sequence; identical to SEQ ID NO: 89964
  derived and/or modified sequence opt1 from neuraminidase__InfluenzaB__AGX21176

SEQ ID NO: 90575 - RNA, 1401 nt, Artificial Sequence
  derived and/or modified sequence opt1 from neuraminidase__InfluenzaB__AGX21187
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgugugccgcgacaacuccuacaccgcgaagcggcccuucgugaagcugaacgucgagaccgacacggccgaggugcgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccugaccuucuccggggugauggugagcaugaaggagccgggcugguacuccuucggguucgagaucaaggacaagaagugcgacguccccugcaucggcaucgagauggugcacgacggcgggaaggagacguggcacagcgccgcgaccgccaucuacugccucaugggcuccgggcagcugcugugggacaccgugaccggcgucgacauggcccucuga

SEQ ID NO: 90576 - RNA, 1401 nt, Artificial Sequence
  derived and/or modified sequence opt1 from neuraminidase__InfluenzaB__AGX21198
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcgagcccaacgagugcaagcacuucgcccucacccacuacgccgcgcagcccggcggcuacuacaacgggacccgcggcgaccggaacaagcugcgccaccugaucagcgugaagcucgggaagaucccgaccguggagaacuccaucuuccacauggccgccuggagcggcuccgccugccacgacgggaaggaguggacguacaucggcgucgacggccccgacaacaacgcccugcugaagaucaaguacggggaggcguacaccgacaccuaccacagcuacgccaacaacauccuccggacccaggaguccgccugcaacugcaucggcgggaacugcuaccugaugaucacggacggcagcgccagcggcguguccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacggcagcaucaccgggcccugcgaguccaacggcgacaagggcagcgggggcaucaagggcggguucgugcaccagcgcauggccuccaagaucgggcggugguacagccgcacgauguccaagaccgagcggaagggcaugggccucuacgucaaguacgacggggaccccuggaccgacagcgacgcccuggcguuccgcggcgugaugguguccaugaaggagccggggugguacagcuucggcuucgagaucaaggacaagaagugcgacguccccugcaucgggaucgagauggugcacgacggcggcaaggagaccuggcacuccgccgccacggccaucuacugccugauggggagcggccagcuccugugggacaccgugaccggggucgacauggcccuguga

SEQ ID NO: 90577 - RNA, 1401 nt, Artificial Sequence; identical to SEQ ID NO: 89964
  derived and/or modified sequence opt1 from neuraminidase__InfluenzaB__AGX21209

SEQ ID NO: 90578 - RNA, 1401 nt, Artificial Sequence; identical to SEQ ID NO: 90127
  derived and/or modified sequence opt1 from neuraminidase__InfluenzaB__AGX21220

SEQ ID NO: 90579 - RNA, 1401 nt, Artificial Sequence
  derived and/or modified sequence opt1 from neuraminidase__InfluenzaB__AGX21231
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagagcgaguggaccuacccccggcucuccugcccggggagcacguuccagaaggcccugcugaucagcccccaccgcuucggcgagaccaaggggaacuccgcgccccucaucauccgggagcccuucaucgccugcggcccgaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggcccgacaacgacgcccugcucaaggugaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuucccgaccgggcgggucaagcacaccgaggagugcacgugcggcuucgccuccaacaagaccaucgagugcgcgugccgcgacaacagcuacaccgccaagcggcccuucgugaagcugaacguggagaccgacacggccgagauccgccugaugugcaccgacaccuaccucgacacgccccggcccgacgacggguccaucaccggcccgugcgagagcaacggcgacaagggguccggcgggaucaagggcggguucguccaccagcgcauggagagcaagaucggccggugguacucccgcaccaugagcaagaccgagcggaugggcauggggcuguacgugaaguacgacggcgaccccugggccgacuccgacgcccuggcguucagcggggugauggucuccaugaaggagcccggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 90580 - RNA, 1401 nt, Artificial Sequence; identical to SEQ ID NO: 90130
  derived and/or modified sequence opt1 from neuraminidase__InfluenzaB__AGX21242

SEQ ID NO: 90581 - RNA, 1401 nt, Artificial Sequence; identical to SEQ ID NO: 89964
  derived and/or modified sequence opt1 from neuraminidase__InfluenzaB__AGX21253

SEQ ID NO: 90582 - RNA, 1401 nt, Artificial Sequence
  derived and/or modified sequence opt1 from neuraminidase__InfluenzaB__AGX21264
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaacaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccgaacgacgggagcaucaccggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccuccugguacagcuucggcuucgagaucaaggacaagaagugcgacgugccgugcaucgggaucgagauggugcacgacggcggcaaggagaccuggcacuccgccgccacggccaucuacugccucauggggagcggccagcugcugugggacaccgucaccgggguggacauggcccucuga

SEQ ID NO: 90583 - RNA, 1401 nt, Artificial Sequence; identical to SEQ ID NO: 89903
  derived and/or modified sequence opt1 from neuraminidase__InfluenzaB__AGX21275

SEQ ID NO: 90584 - RNA, 1401 nt, Artificial Sequence; identical to SEQ ID NO: 89964
  derived and/or modified sequence opt1 from neuraminidase__InfluenzaB__AGX21286

SEQ ID NO: 90585 - RNA, 1401 nt, Artificial Sequence
  derived and/or modified sequence opt1 from neuraminidase__InfluenzaB__AGX21297
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggacuggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagguccgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccugaccuucuccggggucauggugagcaugaaggagccgggcugguacuccuucggguucgagaucaaggacaagaagugcgacgugcccugcaucggcaucgagaugguccacgacggcgggaaggagacguggcacagcgcggccaccgccaucuacugccucaugggcuccgggcagcugcugugggacaccgugaccggcguggacauggcccucuga

SEQ ID NO: 90586 - RNA, 1401 nt, Artificial Sequence
  derived and/or modified sequence opt1 from neuraminidase__InfluenzaB__AGX21308
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaccgacagcgacgcccuggcgcugcgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 90587 - RNA, 1401 nt, Artificial Sequence; identical to SEQ ID NO: 89908
  derived and/or modified sequence opt1 from neuraminidase__InfluenzaB__AGX21319

SEQ ID NO: 90588 - RNA, 1401 nt, Artificial Sequence; identical to SEQ ID NO: 89903
  derived and/or modified sequence opt1 from neuraminidase__InfluenzaB__AGX21330

SEQ ID NO: 90589 - RNA, 1401 nt, Artificial Sequence; identical to SEQ ID NO: 89903
  derived and/or modified sequence opt1 from neuraminidase__InfluenzaB__AGX21341

SEQ ID NO: 90590 - RNA, 1401 nt, Artificial Sequence; identical to SEQ ID NO: 90130
  derived and/or modified sequence opt1 from neuraminidase__InfluenzaB__AGX21352

SEQ ID NO: 90591 - RNA, 1401 nt, Artificial Sequence
  derived and/or modified sequence opt1 from neuraminidase__InfluenzaB__AGX21363
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcucccaccgcuucggcgagaccaaggggaacagcgcgccccucaucauccgggagccguucguggccugcggccccaacgagugcaagcacuucgcccugacccacuacgccgcgcagcccggcggguacuacaacggcacccgcggggaccggaacaagcugcgccaccucaucuccgugaagcugggcaagauccccacggucgagaacagcaucuuccacauggccgccugguccgggagcgccugccacgacggcaaggaguggaccuacaucggcguggacgggccggacaacaacgcccugcucaaggugaaguacggcgaggcguacaccgacaccuaccacuccuacgccaacaagauccugcggacgcaggagagcgccugcaacugcaucgggggcaacugcuaccugaugaucaccgacggcagcgccuccggggucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgacaccuaccucgacacgccccggccgaacgacggguccaucaccggccccugcgagagcgacggcgacaagggguccggcgggaucaagggcggguucgugcaccagcgcauggagagcaagaucggccggugguacucccgcaccaugagcaagaccgagcggaugggcauggggcuguacgugaaguacgacggcgaccccugggccgacuccgacgcccuggcguucagcggggucaugguguccaugaaggagcccggcugguacagcuucggguucgagaucaaggacaagaagugcgacgugccgugcaucggcaucgagaugguccacgacggcgggaaggagaccuggcacuccgccgccacggccaucuacugccucaugggcagcgggcagcugcugugggacaccgugaccggcguggacauggcccucuga

SEQ ID NO: 90592 - RNA, 1401 nt, Artificial Sequence; identical to SEQ ID NO: 89903
  derived and/or modified sequence opt1 from neuraminidase__InfluenzaB__AGX21374

SEQ ID NO: 90593 - RNA, 1401 nt, Artificial Sequence; identical to SEQ ID NO: 89964
  derived and/or modified sequence opt1 from neuraminidase__InfluenzaB__AGX21385

SEQ ID NO: 90594 - RNA, 1401 nt, Artificial Sequence; identical to SEQ ID NO: 89964
  derived and/or modified sequence opt1 from neuraminidase__InfluenzaB__AGX21396

SEQ ID NO: 90595 - RNA, 1401 nt, Artificial Sequence; identical to SEQ ID NO: 89903
  derived and/or modified sequence opt1 from neuraminidase__InfluenzaB__AGX21407

SEQ ID NO: 90596 - RNA, 1401 nt, Artificial Sequence; identical to SEQ ID NO: 89903
  derived and/or modified sequence opt1 from neuraminidase__InfluenzaB__AGX21418

SEQ ID NO: 90597 - RNA, 1401 nt, Artificial Sequence
  derived and/or modified sequence opt1 from neuraminidase__InfluenzaB__AGX21429
augcugcccagcaccauccagacccucacgcuguuccugaccuccggcggggugcuccugagccuguacgucuccgcccuccugagcuaccugcuccacuccgacauccugcugaaguucagcccgaccgagaucaccgcccccacgaugucccucgacugcgcgaacgccagcaacgugcaggccgugaaccgcuccgucaccaagggcgugaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcccagcccggcggguacuacaacggcacccgcggggaccggaacaagcugcgccaccucaucagcgugaagcugggcaagauccccacggucgagaacuccaucuuccacauggcggccuggagcggguccgccugccacgacggcaaggaguggaccuacaucggcguggacgggccggacaacgacgcccugcucaaggugaaguacggcgaggccuacaccgacaccuaccacagcuacgcgaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgccugccgcgacaacuccuacaccgcgaagcggcccuucgugaagcugaacgucgagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggccuucuccggggucauggugagcaugaaggagcccggcugguacuccuucggguucgagaucaaggacaagaagugcgacgugccgugcaucggcaucgagaugguccacgacggcgggaaggagaccuggcacagcgcggccacggccaucuacugccucaugggcuccgggcagcugcugugggacaccgugaccggcguggacauggcccucuga

SEQ ID NO: 90598 - RNA, 1401 nt, Artificial Sequence; identical to SEQ ID NO: 89964
  derived and/or modified sequence opt1 from neuraminidase__InfluenzaB__AGX21440

SEQ ID NO: 90599 - RNA, 1401 nt, Artificial Sequence; identical to SEQ ID NO: 89964
  derived and/or modified sequence opt1 from neuraminidase__InfluenzaB__AGX21451

SEQ ID NO: 90600 - RNA, 1401 nt, Artificial Sequence; identical to SEQ ID NO: 90548
  derived and/or modified sequence opt1 from neuraminidase__InfluenzaB__AGX21462

SEQ ID NO: 90601 - RNA, 1401 nt, Artificial Sequence
  derived and/or modified sequence opt1 from neuraminidase__InfluenzaB__AGX21473
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgaggcgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagauccugcccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcucaugugcacggacaccuaccuggacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcgcucguguucuccggggucauggugagcaugaaggagcccggcugguacuccuucggguucgagaucaaggacaagaagugcgacgugccgugcaucggcaucgagaugguccacgacggcgggaaggagaccuggcacagcgccgccaccgccaucuacugccugaugggcuccgggcagcugcucugggacacggugaccggcguggacauggcccuguga

SEQ ID NO: 90602 - RNA, 1401 nt, Artificial Sequence; identical to SEQ ID NO: 89908
  derived and/or modified sequence opt1 from neuraminidase__InfluenzaB__AGX21484

SEQ ID NO: 90603 - RNA, 1401 nt, Artificial Sequence; identical to SEQ ID NO: 89964
  derived and/or modified sequence opt1 from neuraminidase__InfluenzaB__AGX21495

SEQ ID NO: 90604 - RNA, 1401 nt, Artificial Sequence; identical to SEQ ID NO: 89964
  derived and/or modified sequence opt1 from neuraminidase__InfluenzaB__AGX21506

SEQ ID NO: 90605 - RNA, 1401 nt, Artificial Sequence
  derived and/or modified sequence opt1 from neuraminidase__InfluenzaB__AGX21517
augcugcccagcaccauccagacccucacgcuguuccugaccuccggcggggugcuccugagccuguacgucuccgcccuccugagcuaccugcucuacuccaacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90606 - RNA, 1401 nt, Artificial Sequence
  derived and/or modified sequence opt1 from neuraminidase__InfluenzaB__AGX21528
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagguccgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccugaccuucuccggggucauggugagcaugaaggagccgggcugguacuccuucggguucgagaucaaggacaagaagugcgacgugcccugcaucggcaucgagaugguccacgacagcggcaaggagacguggcacuccgcggccaccgccaucuacugccucauggggagcggccagcugcugugggacaccgugaccgggguggacauggcccucuga

SEQ ID NO: 90607 - RNA, 1401 nt, Artificial Sequence; identical to SEQ ID NO: 89964
  derived and/or modified sequence opt1 from neuraminidase__InfluenzaB__AGX21539

SEQ ID NO: 90608 - RNA, 1401 nt, Artificial Sequence
  derived and/or modified sequence opt1 from neuraminidase__InfluenzaB__AGX21550
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccgccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagguccgccugaugugcacggacaccuaccucgacaccccgcggcccaacgacgggagcaucaccggccccugcgaguccgacggcgacaaggggagcggcgggaucaagggcggguucgugcaccagcgcauggaguccaagaucggccggugguacagccgcacgauguccaagaccgagcggaugggcauggggcuguacgugaaguacgacggcgaccccugggccgacagcgacgcgcugaccuucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 90609 - RNA, 1401 nt, Artificial Sequence
  derived and/or modified sequence opt1 from neuraminidase__InfluenzaB__AGX21561
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagguccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgaggugcgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccugaccuucuccggggugauggugagcaugaaggagccgggcugguacuccuucggguucgagaucaaggacaagaagugcgacguccccugcaucggcaucgagauggugcacgacggcgggaaggagacguggcacagcgcggccaccgccaucuacugccucaugggcuccgggcagcugcugugggacaccgugaccggcgucgacauggcccucuga

SEQ ID NO: 90610 - RNA, 1401 nt, Artificial Sequence; identical to SEQ ID NO: 89908
  derived and/or modified sequence opt1 from neuraminidase__InfluenzaB__AGX21572

SEQ ID NO: 90611 - RNA, 1401 nt, Artificial Sequence
  derived and/or modified sequence opt1 from neuraminidase__InfluenzaB__AGX21583
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgaggcgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagauccugcccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcucaugugcacggacaccuaccuggacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggagcuguacgugaaguacgacggggaccccugggccgacagcgacgcgcucgccuucuccggcgugauggucagcaugaaggagcccgggugguacuccuucggcuucgagaucaaggacaagaagugcgacgugccgugcaucgggaucgagauggugcacgacggcggcaaggagaccuggcacagcgccgccaccgccaucuacugccugaugggguccggccagcugcucugggacacggucaccgggguggacauggcgcuguga

SEQ ID NO: 90612 - RNA, 1401 nt, Artificial Sequence; identical to SEQ ID NO: 89908
  derived and/or modified sequence opt1 from neuraminidase__InfluenzaB__AGX21594

SEQ ID NO: 90613 - RNA, 1401 nt, Artificial Sequence; identical to SEQ ID NO: 90130
  derived and/or modified sequence opt1 from neuraminidase__InfluenzaB__AGX21605

SEQ ID NO: 90614 - RNA, 1401 nt, Artificial Sequence
  derived and/or modified sequence opt1 from neuraminidase__InfluenzaB__AGX21615
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaacaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccgaacgacgggagcaucaccggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90615 - RNA, 1401 nt, Artificial Sequence; identical to SEQ ID NO: 89964
  derived and/or modified sequence opt1 from neuraminidase__InfluenzaB__AGX21626

SEQ ID NO: 90616 - RNA, 1401 nt, Artificial Sequence; identical to SEQ ID NO: 89964
  derived and/or modified sequence opt1 from neuraminidase__InfluenzaB__AGX21637

SEQ ID NO: 90617 - RNA, 1401 nt, Artificial Sequence; identical to SEQ ID NO: 89964
  derived and/or modified sequence opt1 from neuraminidase__InfluenzaB__AGX21648

SEQ ID NO: 90618 - RNA, 1401 nt, Artificial Sequence
  derived and/or modified sequence opt1 from neuraminidase__InfluenzaB__AGX21659
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucgugagcgugaagcugggcaagauccccacggucgagaacuccaucuuccacauggccgccuggagcggguccgccugccacgacggcaaggaguggaccuacaucggcguggacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacacgccccggccggacgacgggagcaucaccggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacggcggggaccccugggccgacagcgacgcccuggcguucuccggcgucauggugagcaugaaggagcccgggugguacuccuucggcuucgagaucaaggacaagaagugcgacgugccgugcaucggcaucgagaugguccacgacgggggcaaggagaccuggcacagcgccgccacggccaucuacugccucaugggguccggccagcugcugugggacaccgugaccggcguggacauggcccucuga

SEQ ID NO: 90619 - RNA, 1401 nt, Artificial Sequence
  derived and/or modified sequence opt1 from neuraminidase__InfluenzaB__AGX21670
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaccgagauggugcacgacggcgggaaggagacguggcacagcgccgccaccgccaucuacugccucaugggcuccgggcagcugcugugggacaccgucaccggcguggacauggcccucuga

SEQ ID NO: 90620 - RNA, 1401 nt, Artificial Sequence
  derived and/or modified sequence opt1 from neuraminidase__InfluenzaB__AGX21681
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggaacggcgggaucaagggcggguucgugcaccagcgcauggccagcaagaucggccggugguacucccgcacgaugagcaagaccgagcggaagggcauggggcucuacgucaaguacgacggcgaccccuggaccgacuccgacgcccuggcguuccgcggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcccuguga

SEQ ID NO: 90621 - RNA, 1401 nt, Artificial Sequence; identical to SEQ ID NO: 89903
  derived and/or modified sequence opt1 from neuraminidase__InfluenzaB__AGX21692

SEQ ID NO: 90622 - RNA, 1401 nt, Artificial Sequence; identical to SEQ ID NO: 90130
  derived and/or modified sequence opt1 from neuraminidase__InfluenzaB__AGX21703

SEQ ID NO: 90623 - RNA, 1401 nt, Artificial Sequence
  derived and/or modified sequence opt1 from neuraminidase__InfluenzaB__AGX21714
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggccucacccugcugcuccccgagccggaguggaccuacccccggcugagcugccccggguccaccuuccagaaggcgcugcucaucagcccccaccgcuucggcgagacgaaggggaacuccgccccgcugaucauccgggagcccuucaucgccugcggccccaacgagugcaagcacuucgcccugacccacuacgcggcccagcccggcggguacuacaacggcacccgcggggaccggaacaagcuccgccaccugaucagcgucaagcugggcaagaucccgaccguggagaacuccaucuuccacauggccgccuggagcggguccgccugccacgacggcaaggaguggacguacaucggcguggacgggcccgacaacaacgcgcuccugaaggucaaguacggcgaggccuacaccgacaccuaccacagcuacgccaacaagauccugcggacccaggaguccgccugcaacugcaucgggggcaacugcuaccucaugaucacggacggcagcgccagcgggguguccgagugccgcuuccugaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgucaagcugaacguggagaccgacaccgccgagauccgccucaugugcacggacaccuaccuggacaccccgcggcccaacgacgggagcaucaccggccccugcgaguccgacggcgacaaggggagcggcgggaucaagggcggguucgugcaccagcgcauggaguccaagaucggccggugguacagccgcacgauguccaagaccgagcggaugggcauggggcuguacgucaaguacgacggcgaccccugggccgacagcgacgcgcucgccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccugaugggcuccgggcagcugcucugggacacggugaccggcgucgacauggcgcuguga

SEQ ID NO: 90624 - RNA, 1401 nt, Artificial Sequence
  derived and/or modified sequence opt1 from neuraminidase__InfluenzaB__AGX21725
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgguccgccacgaagggcgucaccuuccuccugcccgagccggaguggaccuacccccggcugagcugccccggguccaccuuccagcgcgcccuccugaucagcccccaccgguucggcgagacgaaggggaacuccgcgccgcugaucauccgcgagcccuucaucgccugcggccccaacgagugcaagcacuucgcccucacccacuacgccgcgcagcccggcggguacuacaacggcacccgcggggaccggaacaagcugcggcaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccgcacccaggaguccgccugcaacugcaucgggggcaacugcuaccugaugaucacggacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcucaacguggagaccgacaccgccgagauccggcugaugugcacggacaccuaccuggacaccccgcgccccgacgacgggagcaucaccggccccugcgaguccaacggcgacaaggggagcggcgggaucaagggcggguucgugcaccagcggauggccuccaagaucggccgcugguacagccggacgauguccaagaccgagcgcaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 90625 - RNA, 1401 nt, Artificial Sequence
  derived and/or modified sequence opt1 from neuraminidase__InfluenzaB__AGX21747
augcugcccagcaccauccagacccucacgcuguuccugaccuccggcggggugcuccugagccuguacgucuccgccagccucuccuaccugcuguacagcgacauccuccugaaggugucccagaccgagaucaccgccccgacgaugccccuggacugcgcgaacgccagcaacgugcaggccgucaaccgcuccgccaccaagggcgugacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacggucgagaacuccaucuuccacauggccgccuggagcggcuccgccugccacgacgggcgggaguggaccuacaucggcguggacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgucaagcugaacguggagaccgacacggccgagauccggcugaugugcaccgagaccuaccucgacacgccccgcccggacgacggcuccaucaccgggcccugcgagagcaacggcgacaagggcuccgggggcaucaagggcggguucgugcaccagcggauggccagcaagaucgggcgcugguacucccggaccaugagcaagaccaagcgcaugggcaugggccuguacgucaaguacgacggggaccccuggaccgacuccgaggcccuggcgcucagcggcgugaugguguccauggaggagcccgggugguacagcuucggcuucgagaucaaggacaagaagugcgacgucccgugcaucgggaucgagauggugcacgacggcggcaagacgaccuggcacuccgccgccaccgccaucuacugccugauggggagcggccagcugcucugggacaccgugacgggggucgacauggcccuguga

SEQ ID NO: 90626 - RNA, 1401 nt, Artificial Sequence
  derived and/or modified sequence opt1 from neuraminidase__InfluenzaB__AGX21758
augcugcccagcaccauccagacccucacgcuguuccugaccuccggcggggugcuccugagccuguacgucuccgccagccucuccuaccugcuguacagcgacauccuccugaaguucaccccgaccgagaucacggugcccaccaugccccuggacugcgccaacgcguccaacgugcaggccgucaaccgcagcgccaccaagggcgugacccuccugcugcccgagccggaguggacguacccccggcucuccugccccgggagcaccuuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacgcgcgaggaccggaacaagcugcgccaccucaucuccgugaagcuggggaagaucccgaccgucgagaacagcaucuuccacauggcggccugguccggcagcgccugccacgacgggaaggaguggaccuacaucggcguggacggccccgacuccaacgcccugcucaagaucaaguacggggaggccuacaccgacacguaccacagcuacgcgaacaacauccugcggacccaggaguccgccugcaacugcaucggcgggaacugcuaccugaugaucaccgacggcagcgccagcggcaucuccgagugccgcuuccucaagauccgggaggggcgcaucaucaaggagaucuuccccaccggccgggugaagcacacggaggagugcacgugcggguucgccagcaacaagaccaucgagugcgccugccgcgacaacuccuacaccgcgaagcggcccuucgucaagcugaacguggagaccgacaccgccgagauccgccugaugugcaccgagaccuaccucgacacgccgcggcccgacgacggcagcaucaccgggcccugcgaguccaacggcaacaagggcagcgggggcaucaagggcggguucgugcaccagcgcauggccuccaagaucgggcggugguacagccgcaccauguccaagaccaagcggaugggcaugggccuguacgucaaguacgacggggaccccuggacggacagcgacgcccuggcccucuccggcgugauggugagcauggaggagccggggugguacuccuucggcuucgagaucaaggacaagaagugcgacguccccugcaucgggaucgagauggugcacgacggcggcaaggagaccuggcacagcgcggccaccgccaucuacugccugaugggguccggccagcugcucugggacaccgugacgggggucgacauggcccuguga

SEQ ID NO: 90627 - RNA, 1401 nt, Artificial Sequence
  derived and/or modified sequence opt1 from neuraminidase__InfluenzaB__AGX21769
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgccaaccgcuccgccaccaagggcgugacccuccugcugcccgagcccgaguggaccuacccgcggcucagcugccccggguccacguuccagaaggcgcugcugaucagcccccaccgcuucggcgagaccaaggggaacuccgcgccccucaucauccgggagccguucaucgccugcggccccaaggagugcaagcacuucgcccugacccacuacgccgcccagcccggcggguacuacaacggcacccgcgaggaccggaacaagcugcgccaccucaucagcgucaagcuggggaagauccccacgguggagaacuccaucuuccacauggccgccuggagcggcuccgccugccacgacgggcgggaguggaccuacaucggcguggacggcccggacagcaacgcgcugcucaagaucaaguacggggaggccuacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgucaagcacaccgaggagugcacgugcggguucgcguccaacaagaccaucgagugcgccugccgggacaacagcuacaccgccaagcgccccuucgugaagcugaacguggagaccgacacggccgagauccggcugaugugcaccaagaccuaccucgacacgccccgcccgaacgacggcuccaucaccgggcccugcgagagcgacggcgacaagggcuccgggggcaucaagggcggguucguccaccagcggauggccagcaagaucgggcgcugguacucccggaccaugagcaagaccaagcgcaugggcaugggccuguacgugaaguacgacggggaccccuggaccgacuccgaggcgcuggcccucagcggcgugauggucuccauggaggagcccgggugguacagcuucggcuucgagaucaaggacaagaagugcgacgugccgugcaucgggaucgagauggugcacgacggcggcaagacgaccuggcacuccgccgccaccgccaucuacugccugauggggagcggccagcugcucugggacaccgucacggggguggacauggcgcuguga

SEQ ID NO: 90628 - RNA, 1401 nt, Artificial Sequence
  derived and/or modified sequence opt1 from neuraminidase__InfluenzaB__AGX21780
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggcgggaguggaccuacaucggcgucgacggcccggacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacacggccgagauccggcugaugugcaccgagaccuaccucgacacgccccgcccgaacgacggcuccaucaccgggcccugcgagagcaacggcgacaagggcuccgggggcaucaagggcggguucgugcaccagcggauggagagcaagaucgggcgcugguacucccggaccaugagcaagaccaagcgcaugggcaugggccuguacgugaaguacgacggggaccccuggaccgacuccgaggcccuggcccucagcggcgucaugguguccauggaggagcccgggugguacagcuucggcuucgagaucaaggacaagaagugcgacgugccgugcaucgggaucgagaugguccacgacggcggcaagacgaccuggcacuccgcggccaccgccaucuacugccugauggggagcggccagcugcucugggacaccgugacggggguggacaugacccuguga

SEQ ID NO: 90629 - RNA, 1401 nt, Artificial Sequence
  derived and/or modified sequence opt1 from neuraminidase__InfluenzaB__AGX21791
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacagcggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacaacuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaacaagcggaugggcauggggcuguacgugaaguacgacggcgaccccugggccgacagcgacgcgcuggcccucuccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccugaugggcuccgggcagcugcucugggacacggugaccggcguggacauggcgcuguga

SEQ ID NO: 90630 - RNA, 1401 nt, Artificial Sequence
  derived and/or modified sequence opt1 from neuraminidase__InfluenzaB__AGX21802
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgccaaccgcuccgccaccaagggcgugacccuccugcugcccgagcccgaguggaccuacccgcggcucagcugccccggguccacguuccagaaggcgcugcugaucagcccccaccgcuucggcgagaccaaggggaacuccgcgccccucaucauccgggagccguucaucgccugcggccccaaggagugcaagcacuucgcccugacccacuacgccgcccagcccggcggguacuacaacggcacccgcgaggaccggaacaagcugcgccaccucaucagcgucaagcuggggaagauccccacgguggagaacuccaucuuccacauggccgccuggagcggcuccgccugccacgacgggcgggaguggaccuacaucggcguggacggcccggacagcaacgcgcugcucaagaucaaguacggggaggccuacaccgacaccuaccacuccuacgccaagaacauccugcgcacgcaggagagcgccugcaacugcaucggcggggacugcuaccugaugaucaccgacggcagcgccuccggcaucagcgagugccgguuccucaagauccgcgaggggcggaucaucaaggagaucuuccccaccggccgcgucaagcacaccgaggagugcacgugcggguucgcguccaacaagaccaucgagugcgccugccgggacaacagcuacaccgccaagcgccccuucgugaagcugaacguggagaccgacacggccgagauccggcugaugugcaccgagaccuaccucgacacgccccgcccgaacgacggcuccaucaccgggcccugcgagagcgacggcgacaagggcuccgggggcaucaagggcggguucguccaccagcggauggccagcaagaucgggcgcugguacucccggaccaugagcaagaccaagcgcaugggcaugggccuguacgugaaguacgacggggaccccuggaccgacuccgaggcgcuggcccucagcggcgugauggucuccauggaggagcccgggugguacagcuucggcuucgagaucaaggacaagaagugcgacgugccgugcaucgggaucgagauggugcacgacggcggcaagacgaccuggcacuccgccgccaccgccaucuacugccugauggggagcggccagcugcucugggacaccgucacggggguggacauggcgcuguga

SEQ ID NO: 90631 - RNA, 1401 nt, Artificial Sequence
  derived and/or modified sequence opt1 from neuraminidase__InfluenzaB__AGX21813
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaagaugccccuggacugcgcgaacgccagcaacgugcaggccgccaaccgcuccgccacgaagggcgugacccuccugcugcccgagcccgaguggaccuacccgcggcucagcugccccggguccaccuuccagaaggcgcugcugaucagcccccaccgcuucggcgagacgaaggggaacuccgcgccccucaucauccgggagccguucaucgccugcggccccaaggagugcaagcacuucgcccugacccacuacgccgcccagcccggcggguacuacaacggcacccgcgaggaccggaacaagcugcgccaccucaucagcgucaagcuggggaagauccccaccguggagaacuccaucuuccacauggccgccuggagcggcuccgccugccacgacgggcgggaguggacguacaucggcguggacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggcagcgccuccggcaucagcgagugccgguuccucaagauccgcgaggggcggaucaucaaggagaucuuccccaccggccgcgucaagcacaccgaggagugcacgugcggguucgcguccaacaagaccaucgagugcgccugccgggacaacagcuacaccgccaagcgccccuucgugaagcugaacguggagaccgacaccgccgagauccggcugaugugcacggagaccuaccucgacacgccccgcccgaacgacggcuccaucaccgggcccugcgagagcgacggcgacaagggcuccgggggcaucaagggcggguucguccaccagcggauggccagcaagaucgggcgcugguacucccggaccaugagcaagaccaagcgcaugggcaugggccuguacgugaaguacgacggggaccccuggaccgacuccgaggcgcuggcccucagcggcgugauggucuccauggaggagcccgggugguacagcuucggcuucgagaucaaggacaagaagugcgacgugccgugcaucgggaucgagauggugcacgacggcggcaagaccacguggcacuccgccgccaccgccaucuacugccugauggggagcggccagcugcucugggacaccgucaccgggguggacauggcgcuguga

SEQ ID NO: 90632 - RNA, 1401 nt, Artificial Sequence
  derived and/or modified sequence opt1 from neuraminidase__InfluenzaB__AGX21824
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagaacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 90633 - RNA, 1401 nt, Artificial Sequence; identical to SEQ ID NO: 89751
  derived and/or modified sequence opt1 from neuraminidase__InfluenzaB__AGX21835

SEQ ID NO: 90634 - RNA, 1401 nt, Artificial Sequence; identical to SEQ ID NO: 90139
  derived and/or modified sequence opt1 from neuraminidase__InfluenzaB__AGX21846

SEQ ID NO: 90635 - RNA, 1401 nt, Artificial Sequence; identical to SEQ ID NO: 90139
  derived and/or modified sequence opt1 from neuraminidase__InfluenzaB__AGX21857

SEQ ID NO: 90636 - RNA, 1401 nt, Artificial Sequence; identical to SEQ ID NO: 89751
  derived and/or modified sequence opt1 from neuraminidase__InfluenzaB__AGX21868

SEQ ID NO: 90637 - RNA, 1401 nt, Artificial Sequence; identical to SEQ ID NO: 90137
  derived and/or modified sequence opt1 from neuraminidase__InfluenzaB__AGX21879

SEQ ID NO: 90638 - RNA, 1401 nt, Artificial Sequence
  derived and/or modified sequence opt1 from neuraminidase__InfluenzaB__AGX21890
augcugcccagcaccauccagacccucacgcuguuccugaccuccggcggggugcuccugagccuguacgucuccgccagccucuccuaccugcuguacagcgacauccuccugaaguucucccagaccgagaucaucgccccgaucaugccccuggacugcgcgaacgccagcaacgugcaggccgugaaccacuccgccaccaagggcgucacgcuccugcugcccgagcccgaguggaccuacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacgcacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggaccuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccgggguggacauggcccuguga

SEQ ID NO: 90639 - RNA, 1401 nt, Artificial Sequence; identical to SEQ ID NO: 89751
  derived and/or modified sequence opt1 from neuraminidase__InfluenzaB__AGX21901

SEQ ID NO: 90640 - RNA, 1401 nt, Artificial Sequence; identical to SEQ ID NO: 89751
  derived and/or modified sequence opt1 from neuraminidase__InfluenzaB__AGX21912

SEQ ID NO: 90641 - RNA, 1401 nt, Artificial Sequence
  derived and/or modified sequence opt1 from neuraminidase__InfluenzaB__AGX21923
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccaccaagggcgucacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcccagcccggcggguacuacaacggcacccgcgaggaccggaacaagcugcgccaccucaucagcgugaagcuggggaagauccccacgguggagaacuccaucuuccacauggcggccuggagcggcuccgccugccacgacgggcgggaguggaccuacaucggcgucgacggcccggacagcaacgcccugcucaagaucaaguacggggaggccuacaccgacaccuaccacuccuacgcgaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgccugccgggacaacuccuacaccgcgaagcgccccuucgugaagcugaacgucgagaccgacacggccgagauccggcugaugugcaccgagaccuaccucgacaccccgcgccccaacgacggcagcaucacggggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagacgaccuggcacagcgcggccaccgccaucuacugccugaugggguccggccagcugcucugggacaccgugacggggguggacauggcccuguga

SEQ ID NO: 90642 - RNA, 1401 nt, Artificial Sequence; identical to SEQ ID NO: 90638
  derived and/or modified sequence opt1 from neuraminidase__InfluenzaB__AGX21934

SEQ ID NO: 90643 - RNA, 1401 nt, Artificial Sequence; identical to SEQ ID NO: 90139
  derived and/or modified sequence opt1 from neuraminidase__InfluenzaB__AGX21945

SEQ ID NO: 90644 - RNA, 1401 nt, Artificial Sequence
  derived and/or modified sequence opt1 from neuraminidase__InfluenzaB__AGX21956
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacacgagcaacauccaggccgugaaccgcuccgccaccaagggcgugacccuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaaggagugcaagcacuucgcccugacccacuacgccgcccagcccggcggguacuacaacggcacccgcgaggaccggaacaagcugcgccaccucaucagcgucaagcuggggaagauccccacgguggagaacuccaucuuccacauggcggccuggagcggcuccgccugccacgacgggcgggaguggaccuacaucggcguggacggcccggacagcaacgcccugcucaagaucaaguacggggaggccuacaccgacaccuaccacuccuacgcgaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgucaagcacaccgaggagugcacgugcggguucgccagcaacaagaccaucgagugcgccugccgggacaacuccuacaccgcgaagcgccccuucgugaagcugaacguggagaccgacacggccgagauccggcugaugugcaccgagaccuaccucgacaccccgcgccccaacgacggcagcaucacggggcccugcgaguccaacggcgacaagggcagcgggggcaucaagggcggguucguccaccagcggauggccuccaagaucgggcgcugguacagccggaccauguccaagaccaagcgcaugggcaugggccuguacgugaaguacgacggggaccccuggaccgacagcgaggcccuggcccucuccggcgugauggucagcauggaggagccggggugguacuccuucggcuucgagaucaaggacaagaagugcgacgugcccugcaucgggaucgagauggugcacgacggcggcaagacgaccuggcacagcgcggccaccgccaucuacugccugaugggguccggccagcugcucugggacaccgucacggggguggacauggcccuguga

SEQ ID NO: 90645 - RNA, 1401 nt, Artificial Sequence; identical to SEQ ID NO: 90139
  derived and/or modified sequence opt1 from neuraminidase__InfluenzaB__AGX21967

SEQ ID NO: 90646 - RNA, 1401 nt, Artificial Sequence; identical to SEQ ID NO: 89751
  derived and/or modified sequence opt1 from neuraminidase__InfluenzaB__AGX21978

SEQ ID NO: 90647 - RNA, 1401 nt, Artificial Sequence; identical to SEQ ID NO: 90139
  derived and/or modified sequence opt1 from neuraminidase__InfluenzaB__AGX21989

SEQ ID NO: 90648 - RNA, 1401 nt, Artificial Sequence; identical to SEQ ID NO: 90137
  derived and/or modified sequence opt1 from neuraminidase__InfluenzaB__AGX22000

SEQ ID NO: 90649 - RNA, 1401 nt, Artificial Sequence
  derived and/or modified sequence opt1 from neuraminidase__InfluenzaB__AGX22011
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgaagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacaacuacaccgccaagcgccccuucgugaagcugaacgucgagaccgacaccgccgagauccggcugaugugcacggagaccuaccucgacaccccgcgccccaacgacggcuccaucaccgggcccugcgagagcaacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcccuguga

SEQ ID NO: 90650 - RNA, 1401 nt, Artificial Sequence; identical to SEQ ID NO: 89751
  derived and/or modified sequence opt1 from neuraminidase__InfluenzaB__AGX22033

SEQ ID NO: 90651 - RNA, 1401 nt, Artificial Sequence; identical to SEQ ID NO: 89751
  derived and/or modified sequence opt1 from neuraminidase__InfluenzaB__AGX22044

SEQ ID NO: 90652 - RNA, 1401 nt, Artificial Sequence; identical to SEQ ID NO: 90137
  derived and/or modified sequence opt1 from neuraminidase__InfluenzaB__AGX22055

SEQ ID NO: 90653 - RNA, 1401 nt, Artificial Sequence; identical to SEQ ID NO: 89751
  derived and/or modified sequence opt1 from neuraminidase__InfluenzaB__AGX22066

SEQ ID NO: 90654 - RNA, 1401 nt, Artificial Sequence; identical to SEQ ID NO: 90638
  derived and/or modified sequence opt1 from neuraminidase__InfluenzaB__AGX22077

SEQ ID NO: 90655 - RNA, 1401 nt, Artificial Sequence; identical to SEQ ID NO: 89753
  derived and/or modified sequence opt1 from neuraminidase__InfluenzaB__AGX22088

SEQ ID NO: 90656 - RNA, 1401 nt, Artificial Sequence; identical to SEQ ID NO: 90139
  derived and/or modified sequence opt1 from neuraminidase__InfluenzaB__AGX22099

SEQ ID NO: 90657 - RNA, 1401 nt, Artificial Sequence; identical to SEQ ID NO: 90137
  derived and/or modified sequence opt1 from neuraminidase__InfluenzaB__AGX22110

SEQ ID NO: 90658 - RNA, 1401 nt, Artificial Sequence; identical to SEQ ID NO: 90139
  derived and/or modified sequence opt1 from neuraminidase__InfluenzaB__AGX22132

SEQ ID NO: 90659 - RNA, 1401 nt, Artificial Sequence
  derived and/or modified sequence opt1 from neuraminidase__InfluenzaB__AGX22143
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgaucuccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 90660 - RNA, 1401 nt, Artificial Sequence; identical to SEQ ID NO: 90659
  derived and/or modified sequence opt1 from neuraminidase__InfluenzaB__AGX22154

SEQ ID NO: 90661 - RNA, 1401 nt, Artificial Sequence; identical to SEQ ID NO: 90659
  derived and/or modified sequence opt1 from neuraminidase__InfluenzaB__AGX22165

SEQ ID NO: 90662 - RNA, 1401 nt, Artificial Sequence; identical to SEQ ID NO: 90638
  derived and/or modified sequence opt1 from neuraminidase__InfluenzaB__AGX22176

SEQ ID NO: 90663 - RNA, 1401 nt, Artificial Sequence; identical to SEQ ID NO: 90659
  derived and/or modified sequence opt1 from neuraminidase__InfluenzaB__AGX22187

SEQ ID NO: 90664 - RNA, 1401 nt, Artificial Sequence; identical to SEQ ID NO: 90659
  derived and/or modified sequence opt1 from neuraminidase__InfluenzaB__AGX22198

SEQ ID NO: 90665 - RNA, 1401 nt, Artificial Sequence; identical to SEQ ID NO: 90659
  derived and/or modified sequence opt1 from neuraminidase__InfluenzaB__AGX22209

SEQ ID NO: 90666 - RNA, 1401 nt, Artificial Sequence; identical to SEQ ID NO: 90137
  derived and/or modified sequence opt1 from neuraminidase__InfluenzaB__AGX22220

SEQ ID NO: 90667 - RNA, 1401 nt, Artificial Sequence; identical to SEQ ID NO: 90139
  derived and/or modified sequence opt1 from neuraminidase__InfluenzaB__AGX22231

SEQ ID NO: 90668 - RNA, 1401 nt, Artificial Sequence; identical to SEQ ID NO: 90638
  derived and/or modified sequence opt1 from neuraminidase__InfluenzaB__AGX22242

SEQ ID NO: 90669 - RNA, 1401 nt, Artificial Sequence; identical to SEQ ID NO: 90137
  derived and/or modified sequence opt1 from neuraminidase__InfluenzaB__AGX22253

SEQ ID NO: 90670 - RNA, 1401 nt, Artificial Sequence; identical to SEQ ID NO: 89751
  derived and/or modified sequence opt1 from neuraminidase__InfluenzaB__AGX22264

SEQ ID NO: 90671 - RNA, 1401 nt, Artificial Sequence; identical to SEQ ID NO: 90137
  derived and/or modified sequence opt1 from neuraminidase__InfluenzaB__AGX22275

SEQ ID NO: 90672 - RNA, 1401 nt, Artificial Sequence; identical to SEQ ID NO: 89751
  derived and/or modified sequence opt1 from neuraminidase__InfluenzaB__AGX22286

SEQ ID NO: 90673 - RNA, 1401 nt, Artificial Sequence
  derived and/or modified sequence opt1 from neuraminidase__InfluenzaB__AGX22297
augcugcccagcaccauccagacccucacgcuguuccugacccucggcggggugcugcugucccucuacgucagcgccucccugagcuaccugcucuacuccgacauccugcugaaguucagccagaccgagaucaccgccccgaucaugccccucgacugcgcgaacgccuccaacgugcaggccgugaaccgcagcgccacgaagggcgucacccugcugcuccccgagcccgaguggaccuacccgcggcuguccugccccgggagcaccuuccagaaggcccugcucaucagcccccaccgcuucggcgagacgaaggggaacuccgcgccccugaucauccgggagccguucaucgccugcggccccaaggagugcaagcacuucgcccugacccacuacgccgcgcagcccggcggguacuacaacggcacccgcgaggaccggaacaagcuccgccaccugaucuccgugaagcuggggaagauccccaccguggagaacagcaucuuccacauggccgccugguccggcagcgccugccacgacgggcgggaguggacguacaucggcgucgacggcccggacuccaacgcccuccugaagaucaaguacggggaggcguacaccgacaccuaccacagcuacgccaagaacauccugcgcacccaggaguccgccugcaacugcaucggcggggacugcuaccucaugaucacggacggccccgccagcggcaucagcgagugccgguuccugaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacaccgccgagauccggcucaugugcacggagaccuaccuggacaccccgcgccccaacgacggcuccaucaccgggcccugcgagagcaacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccgaggcccucgcgcugagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcuccugugggacaccgugaccgggguggacauggcccuguga

SEQ ID NO: 90674 - RNA, 1401 nt, Artificial Sequence; identical to SEQ ID NO: 89751
  derived and/or modified sequence opt1 from neuraminidase__InfluenzaB__AGX22308

SEQ ID NO: 90675 - RNA, 1401 nt, Artificial Sequence
  derived and/or modified sequence opt1 from neuraminidase__InfluenzaB__AGX22330
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacaugacggccuggagcggcuccgccugccacgacgggaaggaguggaccuacaucggcgucgacggcccggacagcaacgcccugcucaagaucaaguacggggaggccuacaccgacaccuaccacuccuacgcgaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccaccaagaucgggcggugguacucccgcaccaugagcaagaccaagcggaugggcaugggccuguacgugaaguacgacggggaccccuggacggacuccgaggcccuggcccucagcggcgucaugguguccauggaggagccggggugguacagcuucggcuucgagaucaaggacaagaagugcgacgugcccugcaucgggaucgagaugguccacgacggcggcaagaccaccuggcacuccgcggccaccgccaucuacugccugauggggagcggccagcugcucugggacacggugaccgggguggacauggcccuguga

SEQ ID NO: 90676 - RNA, 1401 nt, Artificial Sequence; identical to SEQ ID NO: 90139
  derived and/or modified sequence opt1 from neuraminidase__InfluenzaB__AGX22341

SEQ ID NO: 90677 - RNA, 1401 nt, Artificial Sequence; identical to SEQ ID NO: 90139
  derived and/or modified sequence opt1 from neuraminidase__InfluenzaB__AGX22352

SEQ ID NO: 90678 - RNA, 1401 nt, Artificial Sequence; identical to SEQ ID NO: 90139
  derived and/or modified sequence opt1 from neuraminidase__InfluenzaB__AGX22363

SEQ ID NO: 90679 - RNA, 1401 nt, Artificial Sequence; identical to SEQ ID NO: 90137
  derived and/or modified sequence opt1 from neuraminidase__InfluenzaB__AGX22374

SEQ ID NO: 90680 - RNA, 1401 nt, Artificial Sequence; identical to SEQ ID NO: 89751
  derived and/or modified sequence opt1 from neuraminidase__InfluenzaB__AGX22385

SEQ ID NO: 90681 - RNA, 1401 nt, Artificial Sequence; identical to SEQ ID NO: 89751
  derived and/or modified sequence opt1 from neuraminidase__InfluenzaB__AGX22396

SEQ ID NO: 90682 - RNA, 1401 nt, Artificial Sequence; identical to SEQ ID NO: 90638
  derived and/or modified sequence opt1 from neuraminidase__InfluenzaB__AGX22407

SEQ ID NO: 90683 - RNA, 1401 nt, Artificial Sequence
  derived and/or modified sequence opt1 from neuraminidase__InfluenzaB__AGX22418
augcugcccagcaccauccagacccucacgcuguuccugaccuccggcggggugcuccugagccuguacgucuccgccagccucuccuaccugcuguacagcgacauccuccugaaguucucccagaccgagaucaucgccccgaucaugccccuggacugcgcgaacgccagcaacgugcaggccgugaaccacuccgccaccaagggcgucacgcuccugcugcccgagcccgaguggaccuacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacgcacuacgccgcgcagcccggccgguacuacaacgggacccgcgaggaccggaacaagcugcgccaccucaucagcgugaagcugggcaagauccccaccguggagaacuccaucuuccacauggccgccuggagcggguccgccugccacgacggccgggaguggaccuacaucggggucgacggcccggacagcaacgcccugcucaagaucaaguacggcgaggcguacacggacaccuaccacuccuacgccaagaacauccugcgcacccaggagagcgccugcaacugcaucgggggcgacugcuaccugaugaucaccgacgggcccgccagcggcaucuccgagugccgguuccucaagauccgcgagggccggaucaucaaggagaucuuccccacggggcgcgugaagcacaccgaggagugcacgugcggcuucgccagcaacaagaccaucgagugcgcgugccgggacaacuccuacaccgccaagcgccccuucgugaagcugaacgucgagaccgacaccgccgagauccggcugaugugcaccgagacguaccucgacaccccgcgccccaacgacgggagcaucaccggccccugcgaguccaacggggacaagggcagcggcgggaucaagggcggguucgugcaccagcggauggccuccaagaucggccgcugguacagccggaccauguccaagacgaagcgcauggggaugggccuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacgggggcaagaccaccuggcacagcgccgccacggccaucuacugccugaugggcuccgggcagcugcucugggacaccgugaccggcguggacauggcccuguga

SEQ ID NO: 90684 - RNA, 1401 nt, Artificial Sequence; identical to SEQ ID NO: 90137
  derived and/or modified sequence opt1 from neuraminidase__InfluenzaB__AGX22429

SEQ ID NO: 90685 - RNA, 1401 nt, Artificial Sequence; identical to SEQ ID NO: 90137
  derived and/or modified sequence opt1 from neuraminidase__InfluenzaB__AGX22440

SEQ ID NO: 90686 - RNA, 1401 nt, Artificial Sequence; identical to SEQ ID NO: 90137
  derived and/or modified sequence opt1 from neuraminidase__InfluenzaB__AGX22449

SEQ ID NO: 90687 - RNA, 1401 nt, Artificial Sequence
  derived and/or modified sequence opt1 from neuraminidase__InfluenzaB__AGX22460
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccaccaagggcgucacccuccugcugcccgagcucgaguggaccuacccccggcugagcugcccgggguccacguuccagaaggcccugcucaucagcccccaccgcuucggcgagaccaaggggaacuccgcgccccugaucauccgggagcccuucaucgccugcggcccgaaggagugcaagcacuucgcccugacccacuacgccgcgcagcccggcggguacuacaacggcacccgcgaggaccggaacaagcuccgccaccugaucagcgugaagcuggggaagauccccacgguggagaacuccaucuuccacauggccgccuggagcggcuccgccugccacgacgggcgggaguggaccuacgucggcguggacggccccgacagcaacgcccuccugaagaucaaguacggggaggcguacaccgacaccuaccacuccuacgccaagaacauccugcgcacgcaggagagcgccugcaacugcaucggcggggacugcuaccucaugaucaccgacggcccggccagcggcaucuccgagugccgguuccugaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgccccuucgucaagcuggacguggagaccgacacggccgagauccggcucaugugcaccgagaccuaccuggacacgccccgcccgaacgacggcagcaucaccgggcccugcgaggccaacggcgacaagggcuccgggggcaucaagggcggguucgugcaccagcggauggccagcaagaucgggcgcugguacucccggaccaugagcaagaccaagcgcaugggcaugggccuguacgucaaguacgacggggaccccuggaccgacuccgaggcgcucgcccugagcggcgugaugguguccauggaggagcccgggugguacagcuucggcuucgagaucaaggacaagaagugcgacgucccgugcaucgggaucgagauggugcacgacggcggcaagacgaccuggcacuccgccgccaccgccaucuacugccugauggggagcggccagcuccugugggacaccgugacgggggucgacauggcgcuguga

SEQ ID NO: 90688 - RNA, 1401 nt, Artificial Sequence; identical to SEQ ID NO: 89751
  derived and/or modified sequence opt1 from neuraminidase__InfluenzaB__AGX22471

SEQ ID NO: 90689 - RNA, 1401 nt, Artificial Sequence; identical to SEQ ID NO: 89751
  derived and/or modified sequence opt1 from neuraminidase__InfluenzaB__AGX22482

SEQ ID NO: 90690 - RNA, 1401 nt, Artificial Sequence; identical to SEQ ID NO: 89751
  derived and/or modified sequence opt1 from neuraminidase__InfluenzaB__AGX22493

SEQ ID NO: 90691 - RNA, 1401 nt, Artificial Sequence
  derived and/or modified sequence opt1 from neuraminidase__InfluenzaB__AGX22504
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaucccccuggacugcgcgaacgccagcaacgugcaggccgugaaccgcuccgccaccaagggcgucacccuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaaggagugcaagcacuucgcccugacccacuacgccgcgcagcccggcggguacuacaacggcacgcgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacaccgacacguaccacuccuacgccaacaacauccugcggacccaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacacggaggagugcacgugcggguucgccuccaacaagaccaucgagugcgcgugccgcgacaacagcuacaccgccaagcggcccuucgugaagcugaacgucgagaccgacaccgccgagauccgccugaugugcaccgagaccuaccucgacacgccccggccggacgacggcuccaucaccgggcccugcgagagcaacggcaacaagggcuccgggggcaucaagggcggguucgugcaccagcgcauggccagcaagaucgggcggugguacucccgcaccaugagcaagaccaagcggaugggcaugggccuguacgugaaguacgacggggaccccuggacggacuccgacgcccuggcgcucagcggcgucaugguguccauggaggagcccgggugguacagcuucggcuucgagaucaaggacaagaagugcgacgugccgugcaucgggaucgagaugguccacgacggcggcaaggagaccuggcacuccgccgccaccgccaucuacugccugauggggagcggccagcugcucugggacaccgugacggggguggacauggcccuguga

SEQ ID NO: 90692 - RNA, 1401 nt, Artificial Sequence; identical to SEQ ID NO: 90137
  derived and/or modified sequence opt1 from neuraminidase__InfluenzaB__AGX22515

SEQ ID NO: 90693 - RNA, 1401 nt, Artificial Sequence
  derived and/or modified sequence opt1 from neuraminidase__InfluenzaB__AGX22526
augcugcccagcaccauccagacccucacgcuguuccugaccuccggcggggugcuccugagccuguacgucuccgccagccucuccuaccugcuguacagcgacauccuccagaaguucucccagaccgagaucaccgccccgaucaugccccuggacugcgcgaacgccagcaacgugcaggccgugaaccgcuccgccacgaagggcgucacccugcuccugcccgagcccgaguggaccuacccgcggcugagcugccccggguccaccuuccagaaggcccuccugaucagcccccaccgcuucggcgagacgaaggggaacuccgcgccccugaucauccgggagccguucaucgccugcggccccaccgagugcaagcacuucgcccucacccacuacgccgcgcagcccggcggguacuacaacggcacccgcgaggaccggaacaagcugcgccaccugaucagcgugaagcucgggaagauccccacgguggagaacuccaucuuccacauggccgccuggagcggcuccgccugccacgacgggaaggaguggaccuacaucggcgucgacggcccggacagcaacgcccugcugaagaucaaguacggggaggcguacaccgacaccuaccacuccuacgccaagaacauccuccggacgcaggagagcgccugcaacugcaucggcggggacugcuaccugaugaucaccgacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccucuacgugaaguacgacggggaccccuggaccgacagcgaggcccuggcgcuguccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccucaugggguccggccagcugcugugggacaccgugacggggguggacauggcccucuga

SEQ ID NO: 90694 - RNA, 1401 nt, Artificial Sequence; identical to SEQ ID NO: 89796
  derived and/or modified sequence opt1 from neuraminidase__InfluenzaB__AGX22548

SEQ ID NO: 90695 - RNA, 1401 nt, Artificial Sequence; identical to SEQ ID NO: 89635
  derived and/or modified sequence opt1 from neuraminidase__InfluenzaB__AGX22559

SEQ ID NO: 90696 - RNA, 1401 nt, Artificial Sequence; identical to SEQ ID NO: 89796
  derived and/or modified sequence opt1 from neuraminidase__InfluenzaB__AGX22570

SEQ ID NO: 90697 - RNA, 1401 nt, Artificial Sequence
  derived and/or modified sequence opt1 from neuraminidase__InfluenzaB__AGX22581
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaaggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggcgggaguggacguacaucggcgucgacggcccggacaacaacgcccugcucaagaucaaguacggggaggcguacaccgacaccuaccacagcuacgccaagaacauccugcgcacccaggaguccgccugcaacugcaucggcggggacugcuaccugaugaucacggacggccccgccagcggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacaacuacaccgccaagcgccccuucgugaagcugaacgucgagaccgacaccgccgagauccggcugaugugcacggagaccuaccucgacaccccgcgccccaacgacggcagcaucaccgggcccugcgaguccaacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcccuguga

SEQ ID NO: 90698 - RNA, 1401 nt, Artificial Sequence; identical to SEQ ID NO: 89796
  derived and/or modified sequence opt1 from neuraminidase__InfluenzaB__AGX22592

SEQ ID NO: 90699 - RNA, 1401 nt, Artificial Sequence; identical to SEQ ID NO: 89796
  derived and/or modified sequence opt1 from neuraminidase__InfluenzaB__AGX22603

SEQ ID NO: 90700 - RNA, 1401 nt, Artificial Sequence; identical to SEQ ID NO: 90036
  derived and/or modified sequence opt1 from neuraminidase__InfluenzaB__AGX22614

SEQ ID NO: 90701 - RNA, 1401 nt, Artificial Sequence; identical to SEQ ID NO: 89796
  derived and/or modified sequence opt1 from neuraminidase__InfluenzaB__AGX22625

SEQ ID NO: 90702 - RNA, 1401 nt, Artificial Sequence
  derived and/or modified sequence opt1 from neuraminidase__InfluenzaB__AGX22636
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucgcgcuccugcugcccgagcccgaguggacguacccgcggcucagcugccccggguccaccuuccagaaggcccugcugaucagcccccaccgcuucggcgagaccaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgcgugccacgacgggaaggaguggaccuacaucggcgucgacggcccggacagcaacgcccugcucaagaucaaguacggggaggccuacacggacaccuaccacuccuacgccaagaacauccugcggacccaggagagcgccugcaacugcaucggcggggacugcuaccugaugaucaccgacggccccgcgagcggcaucuccgagugccgcuuccucaagauccgggaggggcgcaucaucaaggagaucuuccccacgggccgggugaagcacaccgaggagugcacgugcggguucgccagcaacaagaccaucgagugcgccugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccgacggcgacaagggcagcgggggcaucaagggcggguucgugcaccagcgcauggcguccaagaucgggcggugguacagccgcaccauguccaagacgaagcggaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggcgaucuacugccugaugggguccggccagcugcucugggacaccgugaccgggguggacauggcccuguga

SEQ ID NO: 90703 - RNA, 1401 nt, Artificial Sequence; identical to SEQ ID NO: 89796
  derived and/or modified sequence opt1 from neuraminidase__InfluenzaB__AGX22647

SEQ ID NO: 90704 - RNA, 1401 nt, Artificial Sequence; identical to SEQ ID NO: 89635
  derived and/or modified sequence opt1 from neuraminidase__InfluenzaB__AGX22658

SEQ ID NO: 90705 - RNA, 1401 nt, Artificial Sequence; identical to SEQ ID NO: 89796
  derived and/or modified sequence opt1 from neuraminidase__InfluenzaB__AGX22669

SEQ ID NO: 90706 - RNA, 1401 nt, Artificial Sequence; identical to SEQ ID NO: 89796
  derived and/or modified sequence opt1 from neuraminidase__InfluenzaB__AGX22680

SEQ ID NO: 90707 - RNA, 1401 nt, Artificial Sequence; identical to SEQ ID NO: 89796
  derived and/or modified sequence opt1 from neuraminidase__InfluenzaB__AGX22691

SEQ ID NO: 90708 - RNA, 1401 nt, Artificial Sequence; identical to SEQ ID NO: 89796
  derived and/or modified sequence opt1 from neuraminidase__InfluenzaB__AGX22702

SEQ ID NO: 90709 - RNA, 1401 nt, Artificial Sequence; identical to SEQ ID NO: 89796
  derived and/or modified sequence opt1 from neuraminidase__InfluenzaB__AGX22713

SEQ ID NO: 90710 - RNA, 1401 nt, Artificial Sequence
  derived and/or modified sequence opt1 from neuraminidase__InfluenzaB__AGX22724
augcugcccagcaccauccagacccucacgcuguuccugaccuccggcggggugcuccugagccuguacgucuccgcccuccugagcuaccugcucuacuccgacauccugcugaaguucagccagaccgagaucaccgccccgaucaugccccucgacugcgcgaacgccuccaacgugcaggccgugaaccgcagcgccacgaagggcgucacccugcugcuccccgagcccgaguggaccuacccgcggcuguccugccccgggagcaccuuccagaaggcccugcucaucagcccccaccgcuucggcgagacgaaggggaacuccgcgccccugaucauccgggagccguucaucgccugcggccccaaggagugcaagcacuucgcccugacccacuacgccgcgcagcccggcggguacuacaacggcacccgcgaggaccggaacaagcuccgccaccugaucuccgugaagcuggggaagauccccaccguggagaacagcaucuuccacauggccgccugguccggcagcgccugccacgacgggcgggaguggacguacaucggcgucgacggcccggacuccaacgcccuccugaagaucaaguacggggaggcguacaccgacaccuaccacagcuacgccaagaacauccugcgcacccaggaguccgccugcaacugcaucggcggggacugcuaccucaugaucacggacggccccgccagcggcaucagcgagugccgguuccugaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgccccuucgugaagcugaacgucgagaccgacaccgccgagauccggcucaugugcacggagaccuaccuggacaccccgcgccccaacgacggcuccaucaccgggcccugcgagagcaacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccgaggcccucgcgcugagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcuccugugggacaccgugaccgggguggacauggcccuguga

SEQ ID NO: 90711 - RNA, 1401 nt, Artificial Sequence; identical to SEQ ID NO: 89796
  derived and/or modified sequence opt1 from neuraminidase__InfluenzaB__AGX22735

SEQ ID NO: 90712 - RNA, 1401 nt, Artificial Sequence
  derived and/or modified sequence opt1 from neuraminidase__InfluenzaB__AGX22746
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaaccgcacccgggaggaccgcaacaagcugcggcaccucaucagcgugaagcugggcaagauccccacgguggagaacuccaucuuccacauggccgccuggagcggguccgccugccacgacggcaaggaguggaccuacaucggggucgacggcccggacagcaacgcccugcucaagaucaaguacggcgaggcguacaccgacaccuaccacuccuacgccaagaacauccugcgcacgcaggagagcgccugcaacugcaucgggggcgacugcuaccugaugaucaccgacgggcccgccagcggcaucuccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccaacgacgggagcaucacgggccccugcgaguccgacggggacaagggcagcggcgggaucaagggcggguucgugcaccagcggauggccuccaagaucggccgcugguacagccggaccauguccaagaccaagcgcauggggaugggccuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacgggggcaagacgaccuggcacagcgccgccaccgccaucuacugccugaugggcuccgggcagcugcucugggacaccgugacgggcguggacauggcccuguga

SEQ ID NO: 90713 - RNA, 1401 nt, Artificial Sequence; identical to SEQ ID NO: 89796
  derived and/or modified sequence opt1 from neuraminidase__InfluenzaB__AGX22757

SEQ ID NO: 90714 - RNA, 1401 nt, Artificial Sequence; identical to SEQ ID NO: 89796
  derived and/or modified sequence opt1 from neuraminidase__InfluenzaB__AGX22768

SEQ ID NO: 90715 - RNA, 1401 nt, Artificial Sequence; identical to SEQ ID NO: 90137
  derived and/or modified sequence opt1 from neuraminidase__InfluenzaB__AGX22779

SEQ ID NO: 90716 - RNA, 1401 nt, Artificial Sequence; identical to SEQ ID NO: 89796
  derived and/or modified sequence opt1 from neuraminidase__InfluenzaB__AGX22790

SEQ ID NO: 90717 - RNA, 1401 nt, Artificial Sequence
  derived and/or modified sequence opt1 from neuraminidase__InfluenzaB__AGX22801
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggccggacagcaacgcgcugcucaagaucaaguacggcgaggccuacaccgacaccuaccacuccuacgccaagaacauccugcggacccaggagagcgccugcaacugcaucgggggcaacugcuaccugaugaucacggacggcagcgccuccggggugagcgagugccgcuuccucaagauccgggagggccgcaucaucaaggagaucuuccccaccgggcgggugaagcacaccgaggagugcacgugcggcuucgcguccaacaagaccaucgagugcgccugccgcgacaacagcuacaccgccaagcggcccuucgucaagcugaacguggagaccgacaccgccgagauccgccugaugugcacggagaccuaccucgacacgccccggccgaacgacggguccaucaccggccccugcgagagcgacggcgacaagggguccggcgggaucaagggcggguucgugcaccagcgcauggccagcaagaucggccggugguacucccgcaccaugagcaagaccaagcggaugggcauggggcuguacgucaaguacgacggcgaccccuggaccgacuccgaggcgcuggcccucagcggggugaugguguccauggaggagcccggcugguacagcuucggguucgagaucaaggacaagaagugcgacgucccgugcaucggcaucgagauggugcacgacggcgggaagaccacguggcacuccgccgccaccgccaucuacugccugaugggcagcgggcagcugcucugggacaccgugaccggcgucgacauggcgcuguga

SEQ ID NO: 90718 - RNA, 1401 nt, Artificial Sequence; identical to SEQ ID NO: 89796
  derived and/or modified sequence opt1 from neuraminidase__InfluenzaB__AGX22812

SEQ ID NO: 90719 - RNA, 1401 nt, Artificial Sequence; identical to SEQ ID NO: 89796
  derived and/or modified sequence opt1 from neuraminidase__InfluenzaB__AGX22823

SEQ ID NO: 90720 - RNA, 1401 nt, Artificial Sequence; identical to SEQ ID NO: 89796
  derived and/or modified sequence opt1 from neuraminidase__InfluenzaB__AGX22834

SEQ ID NO: 90721 - RNA, 1401 nt, Artificial Sequence; identical to SEQ ID NO: 89796
  derived and/or modified sequence opt1 from neuraminidase__InfluenzaB__AGX22845

SEQ ID NO: 90722 - RNA, 1401 nt, Artificial Sequence; identical to SEQ ID NO: 89796
  derived and/or modified sequence opt1 from neuraminidase__InfluenzaB__AGX22856

SEQ ID NO: 90723 - RNA, 1401 nt, Artificial Sequence; identical to SEQ ID NO: 89796
  derived and/or modified sequence opt1 from neuraminidase__InfluenzaB__AGX22867

SEQ ID NO: 90724 - RNA, 1401 nt, Artificial Sequence; identical to SEQ ID NO: 89796
  derived and/or modified sequence opt1 from neuraminidase__InfluenzaB__AGX22878

SEQ ID NO: 90725 - RNA, 1401 nt, Artificial Sequence
  derived and/or modified sequence opt1 from neuraminidase__InfluenzaB__AGX22889
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacucccacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90726 - RNA, 1401 nt, Artificial Sequence; identical to SEQ ID NO: 89635
  derived and/or modified sequence opt1 from neuraminidase__InfluenzaB__AGX22900

SEQ ID NO: 90727 - RNA, 1401 nt, Artificial Sequence
  derived and/or modified sequence opt1 from neuraminidase__InfluenzaB__AGX22911
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaccuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcgcuguga

SEQ ID NO: 90728 - RNA, 1401 nt, Artificial Sequence
  derived and/or modified sequence opt1 from neuraminidase__InfluenzaB__AGX22922
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacaacgaggcccuggcgcucagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacggggguggacauggcccuguga

SEQ ID NO: 90729 - RNA, 1401 nt, Artificial Sequence; identical to SEQ ID NO: 89796
  derived and/or modified sequence opt1 from neuraminidase__InfluenzaB__AGX22933

SEQ ID NO: 90730 - RNA, 1401 nt, Artificial Sequence; identical to SEQ ID NO: 89796
  derived and/or modified sequence opt1 from neuraminidase__InfluenzaB__AGX22944

SEQ ID NO: 90731 - RNA, 1401 nt, Artificial Sequence; identical to SEQ ID NO: 89796
  derived and/or modified sequence opt1 from neuraminidase__InfluenzaB__AGX22955

SEQ ID NO: 90732 - RNA, 1401 nt, Artificial Sequence; identical to SEQ ID NO: 89796
  derived and/or modified sequence opt1 from neuraminidase__InfluenzaB__AGX22966

SEQ ID NO: 90733 - RNA, 1401 nt, Artificial Sequence; identical to SEQ ID NO: 89635
  derived and/or modified sequence opt1 from neuraminidase__InfluenzaB__AGX22977

SEQ ID NO: 90734 - RNA, 1401 nt, Artificial Sequence; identical to SEQ ID NO: 90051
  derived and/or modified sequence opt1 from neuraminidase__InfluenzaB__AGX22988

SEQ ID NO: 90735 - RNA, 1401 nt, Artificial Sequence
  derived and/or modified sequence opt1 from neuraminidase__InfluenzaB__AGX22999
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgagugggcguacccgcggcucagcugccccggguccaccuuccagaaggcccugcugaucagcccccaccgcuucggcgagaccaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgcgugccacgacgggaaggaguggaccuacaucggcgucgacggcccggacagcaacgcccugcucaagaucaaguacggggaggccuacacggacaccuaccacuccuacgccaagaacauccugcggacccaggagagcgccugcaacugcaucggcggggacugcuaccugaugaucaccgacggccccgcgagcggcaucuccgagugccgcuuccucaagauccgggaggggcgcaucaucaaggagaucuuccccacgggccgggugaagcacaccgaggagugcacgugcggguucgccagcaacaagaccaucgagugcgccugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccgacggcgacaagggcagcgggggcaucaagggcggguucgugcaccagcgcauggcguccaagaucgggcggugguacagccgcaccauguccaagacgaagcggaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggcgaucuacugccugaugggguccggccagcugcucugggacaccgugaccgggguggacauggcccuguga

SEQ ID NO: 90736 - RNA, 1401 nt, Artificial Sequence; identical to SEQ ID NO: 90735
  derived and/or modified sequence opt1 from neuraminidase__InfluenzaB__AGX23010

SEQ ID NO: 90737 - RNA, 1401 nt, Artificial Sequence; identical to SEQ ID NO: 89635
  derived and/or modified sequence opt1 from neuraminidase__InfluenzaB__AGX23021

SEQ ID NO: 90738 - RNA, 1401 nt, Artificial Sequence; identical to SEQ ID NO: 89796
  derived and/or modified sequence opt1 from neuraminidase__InfluenzaB__AGX23032

SEQ ID NO: 90739 - RNA, 1401 nt, Artificial Sequence
  derived and/or modified sequence opt1 from neuraminidase__InfluenzaB__AGX23043
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgcccucggcaucagcgagugccgcuuccugaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacaccgccgagauccgccucaugugcacggagaccuaccuggacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcgcucgcccugagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcuccugugggacaccgugaccgggguggacauggcgcuguga

SEQ ID NO: 90740 - RNA, 1401 nt, Artificial Sequence; identical to SEQ ID NO: 89635
  derived and/or modified sequence opt1 from neuraminidase__InfluenzaB__AGX23054

SEQ ID NO: 90741 - RNA, 1401 nt, Artificial Sequence; identical to SEQ ID NO: 89635
  derived and/or modified sequence opt1 from neuraminidase__InfluenzaB__AGX23065

SEQ ID NO: 90742 - RNA, 1401 nt, Artificial Sequence; identical to SEQ ID NO: 89635
  derived and/or modified sequence opt1 from neuraminidase__InfluenzaB__AGX23076

SEQ ID NO: 90743 - RNA, 1401 nt, Artificial Sequence; identical to SEQ ID NO: 89796
  derived and/or modified sequence opt1 from neuraminidase__InfluenzaB__AGX23087

SEQ ID NO: 90744 - RNA, 1401 nt, Artificial Sequence; identical to SEQ ID NO: 89635
  derived and/or modified sequence opt1 from neuraminidase__InfluenzaB__AGX23098

SEQ ID NO: 90745 - RNA, 1401 nt, Artificial Sequence
  derived and/or modified sequence opt1 from neuraminidase__InfluenzaB__AGX23109
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcauccgcggcgacugcuaccugaugaucaccgacgggcccgccagcggcaucuccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccaacgacgggagcaucacgggccccugcgaguccgacggggacaagggcagcggcgggaucaagggcggguucgugcaccagcggauggccuccaagaucggccgcugguacagccggaccauguccaagaccaagcgcauggggaugggccuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacgggggcaagacgaccuggcacagcgccgccaccgccaucuacugccugaugggcuccgggcagcugcucugggacaccgugacgggcguggacauggcccuguga

SEQ ID NO: 90746 - RNA, 1401 nt, Artificial Sequence; identical to SEQ ID NO: 89796
  derived and/or modified sequence opt1 from neuraminidase__InfluenzaB__AGX23120

SEQ ID NO: 90747 - RNA, 1401 nt, Artificial Sequence
  derived and/or modified sequence opt1 from neuraminidase__InfluenzaB__AGX23131
augcugcccagcaccauccagacccucacgcuguuccugaccuccggcggggugcuccugagccuguacgucuccgccagccucuccuaccugcuguacagcgacauccuccugaaguucucccagaccgagaucaucgccccgaucaugccccuggacugcgcgaacgccagcaacgugcaggccgugaaccgcuccgccgccaagggcgucacccuccugcugcccgagcccgaguggacguacccgcggcucagcugccccggguccaccuuccagaaggcgcugcugaucagcccccaccgcuucggcgagaccaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccgacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccgggguggacauggcgcuguga

SEQ ID NO: 90748 - RNA, 1401 nt, Artificial Sequence; identical to SEQ ID NO: 89796
  derived and/or modified sequence opt1 from neuraminidase__InfluenzaB__AGX23142

SEQ ID NO: 90749 - RNA, 1401 nt, Artificial Sequence; identical to SEQ ID NO: 89635
  derived and/or modified sequence opt1 from neuraminidase__InfluenzaB__AGX23153

SEQ ID NO: 90750 - RNA, 1401 nt, Artificial Sequence; identical to SEQ ID NO: 89635
  derived and/or modified sequence opt1 from neuraminidase__InfluenzaB__AGX23164

SEQ ID NO: 90751 - RNA, 1401 nt, Artificial Sequence; identical to SEQ ID NO: 89635
  derived and/or modified sequence opt1 from neuraminidase__InfluenzaB__AGX23175

SEQ ID NO: 90752 - RNA, 1401 nt, Artificial Sequence
  derived and/or modified sequence opt1 from neuraminidase__InfluenzaB__AGX23186
augcugcccagcaccacccagacgcucacccuguuccugaccuccggcggggugcuccugagccuguacgucuccgccagccucuccuaccugcuguacagcgacauccuccugaaguucucccagaccgagaucacggccccgaucaugccccuggacugcgcgaacgccagcaacgugcaggccgugaaccgcuccgccgccaagggcgucacccuccugcugcccgagcccgaguggaccuacccgcggcucagcugccccggguccaccuuccagaaggcgcugcugaucagcccccaccgcuucggcgagacgaaggggaacuccgcgccccucaucauccgggagccguucaucgccugcggccccaccgagugcaagcacuucgcccugacccacuacgccgcccagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcgcugcucaagaucaaguacggggaggccuacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcgcuguga

SEQ ID NO: 90753 - RNA, 1401 nt, Artificial Sequence; identical to SEQ ID NO: 89796
  derived and/or modified sequence opt1 from neuraminidase__InfluenzaB__AGX23197

SEQ ID NO: 90754 - RNA, 1401 nt, Artificial Sequence; identical to SEQ ID NO: 89796
  derived and/or modified sequence opt1 from neuraminidase__InfluenzaB__AGX23208

SEQ ID NO: 90755 - RNA, 1401 nt, Artificial Sequence; identical to SEQ ID NO: 89796
  derived and/or modified sequence opt1 from neuraminidase__InfluenzaB__AGX23219

SEQ ID NO: 90756 - RNA, 1401 nt, Artificial Sequence
  derived and/or modified sequence opt1 from neuraminidase__InfluenzaB__AGX23230
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcgaguacuacaacgggacccgcgaggaccggaacaagcugcgccaccucaucagcgugaagcugggcaagauccccaccguggagaacuccaucuuccacauggccgccuggagcggguccgccugccacgacggcaaggaguggacguacaucggggucgacggcccggacagcaacgcgcugcucaagaucaaguacggcgaggccuacaccgacaccuaccacuccuacgccaagaacauccugcggacccaggagagcgccugcaacugcaucgggggcgacugcuaccugaugaucacggacgggcccagcuccggcaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccaacgacggguccaucaccggccccugcgagagcgacggggacaagggcuccggcgggaucaagggcggguucgugcaccagcgcauggccagcaagaucggccggugguacucccgcacgaugagcaagaccaagcggauggggaugggccuguacgugaaguacgacggcgaccccuggaccgacuccgaggcccuggcgcucagcggggucaugguguccauggaggagccgggcugguacagcuucggguucgagaucaaggacaagaagugcgacgugcccugcaucggcaucgagaugguccacgacgggggcaagaccacguggcacuccgccgccaccgccaucuacugccugaugggcagcgggcagcugcucugggacaccgugaccggcguggacauggcccuguga

SEQ ID NO: 90757 - RNA, 1401 nt, Artificial Sequence; identical to SEQ ID NO: 89635
  derived and/or modified sequence opt1 from neuraminidase__InfluenzaB__AGX23241

SEQ ID NO: 90758 - RNA, 1401 nt, Artificial Sequence; identical to SEQ ID NO: 89796
  derived and/or modified sequence opt1 from neuraminidase__InfluenzaB__AGX23252

SEQ ID NO: 90759 - RNA, 1401 nt, Artificial Sequence; identical to SEQ ID NO: 89796
  derived and/or modified sequence opt1 from neuraminidase__InfluenzaB__AGX23263

SEQ ID NO: 90760 - RNA, 1401 nt, Artificial Sequence; identical to SEQ ID NO: 89796
  derived and/or modified sequence opt1 from neuraminidase__InfluenzaB__AGX23274

SEQ ID NO: 90761 - RNA, 1401 nt, Artificial Sequence; identical to SEQ ID NO: 89635
  derived and/or modified sequence opt1 from neuraminidase__InfluenzaB__AGX23285

SEQ ID NO: 90762 - RNA, 1401 nt, Artificial Sequence; identical to SEQ ID NO: 89796
  derived and/or modified sequence opt1 from neuraminidase__InfluenzaB__AGX23296

SEQ ID NO: 90763 - RNA, 1401 nt, Artificial Sequence
  derived and/or modified sequence opt1 from neuraminidase__InfluenzaB__AGX23307
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 90764 - RNA, 1401 nt, Artificial Sequence; identical to SEQ ID NO: 90763
  derived and/or modified sequence opt1 from neuraminidase__InfluenzaB__AGX23318

SEQ ID NO: 90765 - RNA, 1401 nt, Artificial Sequence; identical to SEQ ID NO: 90763
  derived and/or modified sequence opt1 from neuraminidase__InfluenzaB__AGX23329

SEQ ID NO: 90766 - RNA, 1401 nt, Artificial Sequence; identical to SEQ ID NO: 90763
  derived and/or modified sequence opt1 from neuraminidase__InfluenzaB__AGX23340

SEQ ID NO: 90767 - RNA, 1401 nt, Artificial Sequence; identical to SEQ ID NO: 90763
  derived and/or modified sequence opt1 from neuraminidase__InfluenzaB__AGX23351

SEQ ID NO: 90768 - RNA, 1401 nt, Artificial Sequence; identical to SEQ ID NO: 90763
  derived and/or modified sequence opt1 from neuraminidase__InfluenzaB__AGX23362

SEQ ID NO: 90769 - RNA, 1401 nt, Artificial Sequence; identical to SEQ ID NO: 90763
  derived and/or modified sequence opt1 from neuraminidase__InfluenzaB__AGX23373

SEQ ID NO: 90770 - RNA, 1401 nt, Artificial Sequence; identical to SEQ ID NO: 90763
  derived and/or modified sequence opt1 from neuraminidase__InfluenzaB__AGX23384

SEQ ID NO: 90771 - RNA, 1401 nt, Artificial Sequence
  derived and/or modified sequence opt1 from neuraminidase__InfluenzaB__AGX23395
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucuggaacaccgugaccggggucgacauggcgcuguga

SEQ ID NO: 90772 - RNA, 1401 nt, Artificial Sequence
  derived and/or modified sequence opt1 from neuraminidase__InfluenzaB__AGX23417
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacguuccuccugcccgagcccgaguggaccuacccgcggcugagcugccccggguccaccuuccagaaggcgcuccugaucagcccccaccgcuucggcgagaccaaggggaacuccgcgccccugaucauccgggagccguucaucgccugcggccccacggagugcaagcacuucgcccucacccacuacgccgcccagcccggcggguacuacaacggcacccgcgaggaccggaacaagcugcgccaccugaucagcgugaagcucgggaagauccccaccguggagaacuccaucuuccacauggccgccuggagcggcuccgccugccacgacgggaaggaguggacguacaucggcgucgacggcccggacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcucaacgucgagaccgacaccgccgagauccgccugaugugcacggagaccuaccuggacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccucuacgugaaguacgacggggaccccuggaccgacagcgaggcgcuggcccuguccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccgggguggacauggcgcucuga

SEQ ID NO: 90773 - RNA, 1401 nt, Artificial Sequence; identical to SEQ ID NO: 90772
  derived and/or modified sequence opt1 from neuraminidase__InfluenzaB__AGX23428

SEQ ID NO: 90774 - RNA, 1401 nt, Artificial Sequence; identical to SEQ ID NO: 90155
  derived and/or modified sequence opt1 from neuraminidase__InfluenzaB__AGX23450

SEQ ID NO: 90775 - RNA, 1401 nt, Artificial Sequence
  derived and/or modified sequence opt1 from neuraminidase__InfluenzaB__AGX23461
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacauccaggccgugaaccgguccgccacgaagggcgugacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgucaagcuggggaagauccccaccguggagaacuccaucuuccacauggccgccuggagcggcuccgccugccacgacgggcgcgaguggacguacaucggcguggacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggucaagcacaccgaggagugcacgugcggguucgccagcaacaagaccaucgagugcgcgugccgcgacaacuccuacaccgccaagcggcccuucgugaagcugaacguggagaccgacaccgccgagauccgccugaugugcacggagaccuaccucgacaccccgcggcccaacgacggcagcaucaccgggcccugcgaguccaacggcgacaagggcagcgggggcaucaagggcggguucguccaccagcgcauggccuccaagaucgggcggugguacagccgcacgauguccaagaccaagcggaugggcaugggccuguacgugaaguacgacggggaccccuggaccgacagcgaggcccuggcgcucuccggcgugauggucagcaucgaggagccggggugguacuccuucggcuucgagaucaaggacaagaagugcgacgugcccugcaucgggaucgagauggugcacgacggcggcaagaccacguggcacagcgccgccaccgccaucuacugccugaugggguccggccagcugcucugggacaccgucaccgggguggacauggcccuguga

SEQ ID NO: 90776 - RNA, 1401 nt, Artificial Sequence; identical to SEQ ID NO: 90155
  derived and/or modified sequence opt1 from neuraminidase__InfluenzaB__AGX23472

SEQ ID NO: 90777 - RNA, 1401 nt, Artificial Sequence; identical to SEQ ID NO: 89796
  derived and/or modified sequence opt1 from neuraminidase__InfluenzaB__AGX23483

SEQ ID NO: 90778 - RNA, 1401 nt, Artificial Sequence
  derived and/or modified sequence opt1 from neuraminidase__InfluenzaB__AGX23494
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcggcuccgacggcgacaaggggagcggcgggaucaagggcggguucgugcaccagcgcauggccuccaagaucggccggugguacagccgcacgauguccaagaccaagcggaugggcauggggcuguacgucaaguacgacggcgaccccuggaccgacagcgaggcgcuggcccucuccggggugauggugagcauggacgagccgggcugguacuccuucggguucgagaucaaggacaagaagugcgacguccccugcaucggcaucgagauggugcacgacggcgggaagaccacguggcacagcgccgccaccgccaucuacugccugaugggcuccgggcagcugcucugggacaccgugaccggcgucgacauggcgcuguga

SEQ ID NO: 90779 - RNA, 1401 nt, Artificial Sequence
  derived and/or modified sequence opt1 from neuraminidase__InfluenzaB__AGX23505
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacaacaacgcgcugcucaagaucaaguacggggaggccuacaccgacaccuaccacagcuacgccaagaacauccugcggacccaggaguccgccugcaacugcaucggcggggacugcuaccugaugaucacggacggccccgccagcggcaucagcgagugccgcuuccucaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacaccgccgagauccgccugaugugcacggagaccuaccucgacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcgcuggcccucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcgcuguga

SEQ ID NO: 90780 - RNA, 1401 nt, Artificial Sequence
  derived and/or modified sequence opt1 from neuraminidase__InfluenzaB__AGX23516
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaaggcgaagcggaugggcaugggccuguacgucaaguacgacggggaccccuggaccgacagcgaggcccuggcccucuccggcgugauggugagcauggaggagccggggugguacuccuucggcuucgagaucaaggacaagaagugcgacguccccugcaucgggaucgagauggugcacgacggcggcaagaccaccuggcacagcgccgccacggcgaucuacugccugaugggguccggccagcugcucugggacaccgugaccggggucgacauggcccuguga

SEQ ID NO: 90781 - RNA, 1401 nt, Artificial Sequence; identical to SEQ ID NO: 89796
  derived and/or modified sequence opt1 from neuraminidase__InfluenzaB__AGX23527

SEQ ID NO: 90782 - RNA, 1401 nt, Artificial Sequence
  derived and/or modified sequence opt1 from neuraminidase__InfluenzaB__AGX23538
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccaagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaccaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagacgaccuggcacagcgccgccaccgccaucuacugccugaugggguccggccagcugcucugggacaccgugacgggggucgacauggcgcuguga

SEQ ID NO: 90783 - RNA, 1401 nt, Artificial Sequence
  derived and/or modified sequence opt1 from neuraminidase__InfluenzaB__AGX23549
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaccaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagacgaccuggcacagcgccgccaccgccaucuacugccugaugggguccggccagcugcucugggacaccgugacgggggucgacauggcgcuguga

SEQ ID NO: 90784 - RNA, 1401 nt, Artificial Sequence; identical to SEQ ID NO: 89796
  derived and/or modified sequence opt1 from neuraminidase__InfluenzaB__AGX23560

SEQ ID NO: 90785 - RNA, 1401 nt, Artificial Sequence; identical to SEQ ID NO: 90778
  derived and/or modified sequence opt1 from neuraminidase__InfluenzaB__AGX23571

SEQ ID NO: 90786 - RNA, 1401 nt, Artificial Sequence; identical to SEQ ID NO: 90778
  derived and/or modified sequence opt1 from neuraminidase__InfluenzaB__AGX23582

SEQ ID NO: 90787 - RNA, 1401 nt, Artificial Sequence
  derived and/or modified sequence opt1 from neuraminidase__InfluenzaB__AGX23593
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcugacccucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 90788 - RNA, 1401 nt, Artificial Sequence; identical to SEQ ID NO: 89796
  derived and/or modified sequence opt1 from neuraminidase__InfluenzaB__AGX23604

SEQ ID NO: 90789 - RNA, 1401 nt, Artificial Sequence
  derived and/or modified sequence opt1 from neuraminidase__InfluenzaB__AGX23615
augcugcccagcaccauccagacccucacgcuguuccugaccuccggcggggugcuccugagccuguacgucuccgccagccucuccuaccugcuguacagcgacauccuccugaaguucucccagaccgagaucaccacgccgaucaugccccuggacugcgccaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagacgaaggggaacuccgcgccccucaucauccgggagccguucaucgccugcggccccaccgagugcaagcacuucgcccugacccacuacgccgcgcagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacggggguggacauggcccuguga

SEQ ID NO: 90790 - RNA, 1401 nt, Artificial Sequence; identical to SEQ ID NO: 90778
  derived and/or modified sequence opt1 from neuraminidase__InfluenzaB__AGX23626

SEQ ID NO: 90791 - RNA, 1401 nt, Artificial Sequence; identical to SEQ ID NO: 90155
  derived and/or modified sequence opt1 from neuraminidase__InfluenzaB__AGX23637

SEQ ID NO: 90792 - RNA, 1401 nt, Artificial Sequence; identical to SEQ ID NO: 89796
  derived and/or modified sequence opt1 from neuraminidase__InfluenzaB__AGX23659

SEQ ID NO: 90793 - RNA, 1401 nt, Artificial Sequence; identical to SEQ ID NO: 90155
  derived and/or modified sequence opt1 from neuraminidase__InfluenzaB__AGX23670

SEQ ID NO: 90794 - RNA, 1401 nt, Artificial Sequence; identical to SEQ ID NO: 90155
  derived and/or modified sequence opt1 from neuraminidase__InfluenzaB__AGX23681

SEQ ID NO: 90795 - RNA, 1401 nt, Artificial Sequence; identical to SEQ ID NO: 90155
  derived and/or modified sequence opt1 from neuraminidase__InfluenzaB__AGX23692

SEQ ID NO: 90796 - RNA, 1401 nt, Artificial Sequence; identical to SEQ ID NO: 90155
  derived and/or modified sequence opt1 from neuraminidase__InfluenzaB__AGX23703

SEQ ID NO: 90797 - RNA, 1401 nt, Artificial Sequence
  derived and/or modified sequence opt1 from neuraminidase__InfluenzaB__AGX23714
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgagaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcggcuccgacggcgacaaggggagcggcgggaucaagggcggguucgugcaccagcgcauggccuccaagaucggccggugguacagccgcacgauguccaagaccaagcggaugggcauggggcuguacgucaaguacgacggcgaccccuggaccgacagcgaggcccuggcgcucuccggggugauggugagcauggacgagccgggcugguacuccuucggguucgagaucaaggacaagaagugcgacguccccugcaucggcaucgagauggugcacgacggcgggaagaccacguggcacagcgccgccaccgccaucuacugccugaugggcuccgggcagcugcucugggacaccgugaccggcgucgacauggcccuguga

SEQ ID NO: 90798 - RNA, 1401 nt, Artificial Sequence; identical to SEQ ID NO: 90155
  derived and/or modified sequence opt1 from neuraminidase__InfluenzaB__AGX23725

SEQ ID NO: 90799 - RNA, 1401 nt, Artificial Sequence; identical to SEQ ID NO: 90778
  derived and/or modified sequence opt1 from neuraminidase__InfluenzaB__AGX23736

SEQ ID NO: 90800 - RNA, 1401 nt, Artificial Sequence; identical to SEQ ID NO: 90155
  derived and/or modified sequence opt1 from neuraminidase__InfluenzaB__AGX23747

SEQ ID NO: 90801 - RNA, 1401 nt, Artificial Sequence; identical to SEQ ID NO: 90155
  derived and/or modified sequence opt1 from neuraminidase__InfluenzaB__AGX23758

SEQ ID NO: 90802 - RNA, 1401 nt, Artificial Sequence; identical to SEQ ID NO: 90778
  derived and/or modified sequence opt1 from neuraminidase__InfluenzaB__AGX23769

SEQ ID NO: 90803 - RNA, 1401 nt, Artificial Sequence
  derived and/or modified sequence opt1 from neuraminidase__InfluenzaB__AGX23780
augcugcccagcaccauccagacccucacgcugcugcucaccuccggcggggugcugcugagccucuacgucuccgccagccuguccuaccugcucuacagcgacauccugcugaaguucucccagaccgagaucaccgccccgaucaugccccucgacugcgcgaacgccagcaacgugcaggccgugaaccgcuccgccgccaagggcgucacgcugcugcuccccgagcccgaguggaccuacccgcggcugagcugccccggguccaccuuccagaaggcgcugcucaucagcccccaccgcuucggcgagaccaaggggaacuccgcgccccugaucauccgggagccguucaucgccugcggccccacggagugcaagcacuucgcccugacccacuacgccgcccagcccggcggguacuacaacggcacccgcgaggaccggaacaagcuccgccaccugaucagcgugaagcuggggaagauccccaccguggagaacuccaucuuccacauggccgccuggagcggcuccgccugccacgacgggaaggaguggacguacaucggcgucgacggcccggacagcaacgcgcuccugaagaucaaguacggggaggccuacaccgacaccuaccacuccuacgccaagaacauccugcggacccaggagagcgccugcaacugcaucggcggggacugcuaccucaugaucacggacggccccgccagcggcguguccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccucaugugcacggagaccuaccuggacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcucgcccuguccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcuccugugggacaccgugaccggggucgacauggcgcuguga

SEQ ID NO: 90804 - RNA, 1401 nt, Artificial Sequence
  derived and/or modified sequence opt1 from neuraminidase__InfluenzaB__AGX23791
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgcccaggccgugaaccgcuccgccgcgaagggcgugacgcuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgucaagcuggggaagauccccaccguggagaacuccaucuuccacauggccgccuggagcggcuccgcgugccacgacgggaaggaguggacguacaucggcguggacggcccggacagcaacgcccugcucaagaucaaguacggggaggccuacaccgacaccuaccacuccuacgccaagaacauccugcggacccaggagagcgccugcaacugcaucggcggggacugcuaccugaugaucacggacggccccgcgagcggcgucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggcguccaagaucgggcggugguacagccgcacgauguccaagaccaagcggaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgcgaucuacugccugaugggguccggccagcugcucugggacaccgugaccgggguggacauggcccuguga

SEQ ID NO: 90805 - RNA, 1401 nt, Artificial Sequence; identical to SEQ ID NO: 90778
  derived and/or modified sequence opt1 from neuraminidase__InfluenzaB__AGX23802

SEQ ID NO: 90806 - RNA, 1401 nt, Artificial Sequence; identical to SEQ ID NO: 90778
  derived and/or modified sequence opt1 from neuraminidase__InfluenzaB__AGX23813

SEQ ID NO: 90807 - RNA, 1401 nt, Artificial Sequence; identical to SEQ ID NO: 90778
  derived and/or modified sequence opt1 from neuraminidase__InfluenzaB__AGX23824

SEQ ID NO: 90808 - RNA, 1401 nt, Artificial Sequence; identical to SEQ ID NO: 90778
  derived and/or modified sequence opt1 from neuraminidase__InfluenzaB__AGX23846

SEQ ID NO: 90809 - RNA, 1401 nt, Artificial Sequence; identical to SEQ ID NO: 89796
  derived and/or modified sequence opt1 from neuraminidase__InfluenzaB__AGX23857

SEQ ID NO: 90810 - RNA, 1401 nt, Artificial Sequence; identical to SEQ ID NO: 90778
  derived and/or modified sequence opt1 from neuraminidase__InfluenzaB__AGX23868

SEQ ID NO: 90811 - RNA, 1401 nt, Artificial Sequence
  derived and/or modified sequence opt1 from neuraminidase__InfluenzaB__AGX23879
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagacguccaucuuccacauggccgccuggagcggcuccgccugccacgacgggaaggaguggaccuacaucggcgucgacggcccggacagcaacgcgcugcucaagaucaaguacggggaggccuacaccgacaccuaccacuccuacgccaagaacauccugcggacgcaggagagcgccugcaacugcaucggcggggacugcuaccugaugaucaccgacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacacggccgagauccgccugaugugcaccgagaccuaccucgacaccccgcggcccaacgacggcagcaucacggggcccugcgaguccgacggcgacaagggcagcgggggcaucaagggcggguucgugcaccagcgcauggccuccaagaucgggcggugguacagccgcaccauguccaagaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagacgaccuggcacagcgccgccaccgccaucuacugccugaugggguccggccagcugcucugggacaccgugacgggggucgacauggcgcuguga

SEQ ID NO: 90812 - RNA, 1401 nt, Artificial Sequence; identical to SEQ ID NO: 90778
  derived and/or modified sequence opt1 from neuraminidase__InfluenzaB__AGX23890

SEQ ID NO: 90813 - RNA, 1401 nt, Artificial Sequence; identical to SEQ ID NO: 89796
  derived and/or modified sequence opt1 from neuraminidase__InfluenzaB__AGX23901

SEQ ID NO: 90814 - RNA, 1401 nt, Artificial Sequence
  derived and/or modified sequence opt1 from neuraminidase__InfluenzaB__AGX23912
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaaccgccugcggcaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgucaagcugaacguggagaccgacaccgccgagauccggcugaugugcacggagaccuaccucgacaccccgcgccccaacgacggcagcaucaccgggcccugcggcuccgacggcgacaaggggagcggcgggaucaagggcggguucgugcaccagcggauggccuccaagaucggccgcugguacagccggacgauguccaagaccaagcgcaugggcauggggcuguacgucaaguacgacggcgaccccuggaccgacagcgaggcgcuggcccucuccggggugauggugagcauggacgagccgggcugguacuccuucggguucgagaucaaggacaagaagugcgacguccccugcaucggcaucgagauggugcacgacggcgggaagaccacguggcacagcgccgccaccgccaucuacugccugaugggcuccgggcagcugcucugggacaccgugaccggcgucgacauggcgcuguga

SEQ ID NO: 90815 - RNA, 1401 nt, Artificial Sequence; identical to SEQ ID NO: 89968
  derived and/or modified sequence opt1 from neuraminidase__InfluenzaB__AGX23934

SEQ ID NO: 90816 - RNA, 1401 nt, Artificial Sequence
  derived and/or modified sequence opt1 from neuraminidase__InfluenzaB__AGX23945
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccggaucaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcggcuccgacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccuggaccgacagcgaggcgcuggcccucuccggggucauggugagcauggacgagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcguggacauggcgcuguga

SEQ ID NO: 90817 - RNA, 1401 nt, Artificial Sequence
  derived and/or modified sequence opt1 from neuraminidase__InfluenzaB__AGX23956
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcaucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcgucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90818 - RNA, 1401 nt, Artificial Sequence; identical to SEQ ID NO: 90155
  derived and/or modified sequence opt1 from neuraminidase__InfluenzaB__AGX23967

SEQ ID NO: 90819 - RNA, 1401 nt, Artificial Sequence; identical to SEQ ID NO: 89968
  derived and/or modified sequence opt1 from neuraminidase__InfluenzaB__AGX23978

SEQ ID NO: 90820 - RNA, 1401 nt, Artificial Sequence
  derived and/or modified sequence opt1 from neuraminidase__InfluenzaB__AGX23989
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacaaggccgagauccggcugaugugcaccgagacguaccucgacaccccgcgccccaacgacggcuccaucaccgggcccugcgagagcgacggcgacaagggcuccgggggcaucaagggcggguucgugcaccagcggauggccagcaagaucgggcgcugguacucccggaccaugagcaagacgaagcgcaugggcaugggccuguacgugaaguacgacggggaccccuggaccgacuccggcgcgcuggcccucagcggggucaugguguccaucgaggagccgggcugguacagcuucggguucgagaucaaggacaagaagugcgacgugcccugcaucggcaucgagaugguccacgacggcgggaagaccaccuggcacuccgccgccacggccaucuacugccugaugggcagcgggcagcugcucugggacaccgugaccggcguggacauggcgcuguga

SEQ ID NO: 90821 - RNA, 1401 nt, Artificial Sequence; identical to SEQ ID NO: 90778
  derived and/or modified sequence opt1 from neuraminidase__InfluenzaB__AGX24000

SEQ ID NO: 90822 - RNA, 1401 nt, Artificial Sequence
  derived and/or modified sequence opt1 from neuraminidase__InfluenzaB__AGX24011
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaucgacaccuaccacuccuacgccaagaacauccugcgcacccaggagagcgccugcaacugcaucggcggggacugcuaccugaugaucaccgacggccccgccagcggcaucuccgagugccgguuccucaagauccgcgaggggcggaucaucaaggagaucuuccccacgggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcaccgagacguaccucgacaccccgcgccccaacgacggcagcaucaccgggcccugcgaguccgacggcgacaagggcagcgggggcaucaagggcggguucgugcaccagcggauggccuccaagaucgggcgcugguacagccggaccauguccaagacgaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccgggguggacauggcgcuguga

SEQ ID NO: 90823 - RNA, 1401 nt, Artificial Sequence; identical to SEQ ID NO: 89968
  derived and/or modified sequence opt1 from neuraminidase__InfluenzaB__AGX24022

SEQ ID NO: 90824 - RNA, 1401 nt, Artificial Sequence
  derived and/or modified sequence opt1 from neuraminidase__InfluenzaB__AGX24033
augcugcccagcaccauccagacccucacgcuguuccugaccuccggcggggugcuccugagccuguacgucuccgccagccucuccuaccugcuguacagcgacauccuccugaaguucucccagaccgagaucaccgcccagaucaugccgcuggacugcgcgaacgccagcaacgugcaggccgugaaccgcuccgccgccaagggcgucacgcuccugcugcccgagcccgaguggaccuacccccggcucagcugcccgggguccaccuuccagaaggcgcugcugaucagcccccaccgcuucggcgagaccaaggggaacuccgcgccccucaucauccgggagcccuucaucgccugcggcccgacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggccccgacagcaacgcgcugcucaagaucaaguacggggaggccuacaccgacaccuaccacuccuacgccaagaacauccugcggacccaggagagcgccugcaacugcaucggcggggacugcuaccugaugaucacggacggcccggccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacaaggccgagauccggcugaugugcaccgagacguaccucgacacgccccgcccgaacgacggcuccaucaccgggcccugcgagagcgacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccggcgcgcuggcccucagcggggucaugguguccaucgaggagcccggcugguacagcuucggguucgagaucaaggacaagaagugcgacgugccgugcaucggcaucgagaugguccacgacggcgggaagaccaccuggcacuccgccgccacggccaucuacugccugaugggcagcgggcagcugcucugggacaccgugaccggcguggacauggcgcuguga

SEQ ID NO: 90825 - RNA, 1401 nt, Artificial Sequence; identical to SEQ ID NO: 89968
  derived and/or modified sequence opt1 from neuraminidase__InfluenzaB__AGX24044

SEQ ID NO: 90826 - RNA, 1401 nt, Artificial Sequence
  derived and/or modified sequence opt1 from neuraminidase__InfluenzaB__AGX24055
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacccuccugcugcccgagcucgaguggaccuacccccggcugagcugcccgggguccaccuuccagaaggcccugcucaucagcccccaccgcuucggcgagacgaaggggaacuccgcgccccugaucauccgggagcccuucguggccugcggcccgaccgagugcaagcacuucgcccugacccacuacgccgcgcagcccggcggguacuacaacggcacccgcgaggaccggaacaagcuccgccaccugaucagcgugaagcuggggaagauccccacggucgagaacuccaucuuccacauggccgccuggagcggcuccgccugccacgacgggaaggaguggaccuacaucggcguggacggccccaacagcaacgcccuccugaagaucaaguacggggaggcguacaccgacaccuaccacuccuacgccaagaacauccugcggacgcaggagagcgccugcaacugcaucggcggggacugcuaccucaugaucaccgacggcccggccagcggcguguccgagugccgcuuccugaagauccgggaggggcgcaucaucaaggagaucuuccccaccggccgggucaagcacaccgaggagugcacgugcggguucgccagcaacaagaccaucgagugcgcgugccgcgacaacuccuacaccgccaagcggcccuucgugaagcugaacguggagaccgacacggccgagauccgccucaugugcaccgagaccuaccuggacacgccccggccgaacgacggcagcaucaccgggcccugcgaguccgacggcgacaagggcagcgggggcaucaagggcggguucguccaccagcgcauggccuccaagaucgggcggugguacagccgcaccauguccaagaccaagcggaugggcaugggccuguacgugaaguacgacggggaccccuggaccgacagcgaggcccucgcgcuguccggcgugauggucagcauggaggagcccgggugguacuccuucggcuucgagaucaaggacaagaagugcgacgugccgugcaucgggaucgagauggugcacgacggcggcaagacgaccuggcacagcgccgccaccgccaucuacugccugaugggguccggccagcuccugugggacaccgucacggggguggacauggcccuguga

SEQ ID NO: 90827 - RNA, 1401 nt, Artificial Sequence; identical to SEQ ID NO: 89825
  derived and/or modified sequence opt1 from neuraminidase__InfluenzaB__AGX24066

SEQ ID NO: 90828 - RNA, 1401 nt, Artificial Sequence
  derived and/or modified sequence opt1 from neuraminidase__InfluenzaB__AGX24077
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcgggaacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacaaggccgagauccggcugaugugcaccgagacguaccucgacaccccgcgccccaacgacggcuccaucaccgggcccugcgagagcgacggcgacaagggcuccgggggcaucaagggcggguucgugcaccagcggauggccagcaagaucgggcgcugguacucccggaccaugagcaagacgaagcgcaugggcaugggccuguacgugaaguacgacggggaccccugggcggacuccggcgcccuggcccucagcggggucaugguguccaucgaggagccgggcugguacagcuucggguucgagaucaaggacaagaagugcgacgugcccugcaucggcaucgagaugguccacgacggcgggaagaccaccuggcacuccgccgccaccgcgaucuacugccugaugggcagcgggcagcugcucugggacacggugaccggcguggacauggcccuguga

SEQ ID NO: 90829 - RNA, 1401 nt, Artificial Sequence
  derived and/or modified sequence opt1 from neuraminidase__InfluenzaB__AGX24088
augcugcccagcaccauccagacccucacgcuguucaucaccuccggcggggugcugcucagccuguacgucuccgccagccuguccuaccuccuguacagcgacauccugcucaaguucucccagaccgagaucaccgccccgaucaugccccuggacugcgcgaacgccagcaacgugcaggccgugaaccgcuccgccgccaagggcgucacgcugcuccugcccgagcccgaguggaccuacccgcggcugagcugccccggguccaccuuccagaaggcgcuccugaucagcccccaccgcuucggcgagaccaaggggaacuccgcgccccugaucauccgggagccguucaucgccugcggccccacggagugcaagcacuucgcccucacccacuacgccgcccagcccggcggguacuacaacggcacccgcgaggaccggaacaagcugcgccaccugaucagcgugaagcucgggaagauccccaccguggagaacuccaucuuccacauggccgccuggagcggcuccgccugccacgacgggaaggaguggacguacgucggcguggacggcccggacagcgacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcucaacguggagaccgacaccgccgagauccgccugaugugcacggagaccuaccuggacaccccgcggcccaacgacggcagcaucaccgggcccugcggcuccgacggcgacaaggggagcggcgggaucaagggcggguucgugcaccagcgcauggccuccaagaucggccggugguacagccgcacgauguccaagaccaagcggaugggcauggggcucuacgucaaguacgacggcgaccccuggaccgacagcgaggcgcuggcccuguccggggugauggugagcauggacgagccgggcugguacuccuucggguucgagaucaaggacaagaagugcgacguccccugcaucggcaucgagauggugcacgacggcgggaagaccacguggcacagcgccgccaccgccaucuacugccucaugggcuccgggcagcugcugugggacaccgugaccggcgucgacauggcgcucuga

SEQ ID NO: 90830 - RNA, 1401 nt, Artificial Sequence; identical to SEQ ID NO: 89968
  derived and/or modified sequence opt1 from neuraminidase__InfluenzaB__AGX24099

SEQ ID NO: 90831 - RNA, 1401 nt, Artificial Sequence
  derived and/or modified sequence opt1 from neuraminidase__InfluenzaB__AGX24110
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcacgugccgcgacaacuccuacaccgccaagcggcccuucgucaagcugaacguggagaccgacaccgccgagauccgccugaugugcaccgagaccuaccucgacaccccgcggcccaacgacggcagcaucacggggcccugcggcuccgacggcgacaaggggagcggcgggaucaagggcggguucgugcaccagcgcauggccuccaagaucggccggugguacagccgcaccauguccaagaccaagcggaugggcauggggcuguacgucaaguacgacggcgaccccuggaccgacagcgaggcccuggcgcucuccggggugauggugagcauggacgagccgggcugguacuccuucggguucgagaucaaggacaagaagugcgacguccccugcaucggcaucgagauggugcacgacggcgggaagacgaccuggcacagcgccgccaccgccaucuacugccugaugggcuccgggcagcugcucugggacaccgugacgggcgucgacauggcccuguga

SEQ ID NO: 90832 - RNA, 1401 nt, Artificial Sequence
  derived and/or modified sequence opt1 from neuraminidase__InfluenzaB__AGX24121
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgccaagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90833 - RNA, 1401 nt, Artificial Sequence
  derived and/or modified sequence opt1 from neuraminidase__InfluenzaB__AGX24132
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccucccccugcccgagccggaguggaccuacccccgccugagcugccccggguccaccuuccagaaggcccuccugaucagcccccaccgguucggcgagacgaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgcccugggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggccguucgugaagcugaacgucgagaccgacaccgccgagauccgccugaugugcacggagaccuaccucgacacgccccggcccaacgacggcuccaucaccgggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggacccguggaccgacuccgaggcccuggcgcucagcggcgucaugguguccauggaggagcccgggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccggggugaacaugacgcuguga

SEQ ID NO: 90834 - RNA, 1401 nt, Artificial Sequence
  derived and/or modified sequence opt1 from neuraminidase__InfluenzaB__AGX24143
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacgggaacgcgcugcucaagaucaaguacggcgaggccuacaccgacaccuaccacagcuacgccaagaacauccugcggacccaggaguccgccugcaacugcaucgggggcgacugcuaccugaugaucacggacggccccgccagcgggaucagcgagugccgcuuccucaagauccgggagggccgcaucaucaaggagaucuuccccaccgggcgggugaagcacaccgaggagugcacgugcggcuucgcguccaacaagaccaucgagugcgccugccgcgacaacagcuacaccgccaagcggcccuucgugaagcugaacgucgagaccgacaccgccgagauccgccugaugugcacggagaccuaccucgacaccccgcggcccaacgacggguccaucaccggccccugcgagagcgacggcgacaagggguccggcgggaucaagggcggguucgugcaccagcgcauggccagcaagaucggccggugguacucccgcacgaugagcaagaccaagcggaugggcauggggcuguacgugaaguacgacggcgaccccuggaccgacuccgaggcgcuggcccucagcggggucaugguguccauggaggagccgggcugguacagcuucggguucgagaucaaggacaagaagugcgacgugcccugcaucggcaucgagaugguccacgacggcgggaagaccacguggcacuccgccgccaccgccaucuacugccugaugggcagcgggcagcugcucugggacaccgugaccggcguggacauggcgcuguga

SEQ ID NO: 90835 - RNA, 1401 nt, Artificial Sequence; identical to SEQ ID NO: 89968
  derived and/or modified sequence opt1 from neuraminidase__InfluenzaB__AGX24154

SEQ ID NO: 90836 - RNA, 1401 nt, Artificial Sequence
  derived and/or modified sequence opt1 from neuraminidase__InfluenzaB__AGX24165
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucaacggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccgggguggacauggcgcuguga

SEQ ID NO: 90837 - RNA, 1401 nt, Artificial Sequence; identical to SEQ ID NO: 89825
  derived and/or modified sequence opt1 from neuraminidase__InfluenzaB__AGX24176

SEQ ID NO: 90838 - RNA, 1401 nt, Artificial Sequence; identical to SEQ ID NO: 89825
  derived and/or modified sequence opt1 from neuraminidase__InfluenzaB__AGX24187

SEQ ID NO: 90839 - RNA, 1401 nt, Artificial Sequence; identical to SEQ ID NO: 89825
  derived and/or modified sequence opt1 from neuraminidase__InfluenzaB__AGX24198

SEQ ID NO: 90840 - RNA, 1401 nt, Artificial Sequence; identical to SEQ ID NO: 90155
  derived and/or modified sequence opt1 from neuraminidase__InfluenzaB__AGX24231

SEQ ID NO: 90841 - RNA, 1401 nt, Artificial Sequence; identical to SEQ ID NO: 89825
  derived and/or modified sequence opt1 from neuraminidase__InfluenzaB__AGX24242

SEQ ID NO: 90842 - RNA, 1401 nt, Artificial Sequence
  derived and/or modified sequence opt1 from neuraminidase__InfluenzaB__AGX24275
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaaccgcaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagacccgccggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90843 - RNA, 1401 nt, Artificial Sequence; identical to SEQ ID NO: 90420
  derived and/or modified sequence opt1 from neuraminidase__InfluenzaB__AGX24286

SEQ ID NO: 90844 - RNA, 1401 nt, Artificial Sequence
  derived and/or modified sequence opt1 from neuraminidase__InfluenzaB__AGX24297
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagacccgggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90845 - RNA, 1401 nt, Artificial Sequence; identical to SEQ ID NO: 90420
  derived and/or modified sequence opt1 from neuraminidase__InfluenzaB__AGX24319

SEQ ID NO: 90846 - RNA, 1401 nt, Artificial Sequence
  derived and/or modified sequence opt1 from neuraminidase__InfluenzaB__AGX24330
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcacgugccgggacaacuccuacaccgccaagcgccccuucgugaagcugaacgucgagaccgacaccgccgagauccggcugaugugcaccgagaccuaccucgacaccccgcgccccaacgacggcagcaucacggggcccugcgaguccgacggcgacaagggcagcgggggcaucaagggcggguucgugcaccagcggauggccuccaagaucgggcgcugguacagccggaccauguccaagaccaagcgcaugggcaugggccuguacgugaaguacgacggggaccccuggaccgacagcgaggcccuggcgcucuccggcgucaugaucagcauggaggagccggggugguacuccuucggcuucgagaucaaggacaagaagugcgacgugcccugcaucgggaucgagauggugcacgacggcggcaagacgaccugguacagcgccgccaccgccaucuacugccugaugggguccggccagcugcucugggacaccgucacggggguggacauggcccuguga

SEQ ID NO: 90847 - RNA, 1401 nt, Artificial Sequence
  derived and/or modified sequence opt1 from neuraminidase__InfluenzaB__AGX24341
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccugacccucuccggcgucauggugagcauggaggagccggggugguacuccuucggcuucgagaucaaggacaagaagugcgacgugcccugcaucgggaucgagaugguccacgacggcggcaagacgaccuggcacagcgcggccaccgccaucuacugccugaugggguccggccagcugcucugggacaccgugacgggggugaacaugacccuguga

SEQ ID NO: 90848 - RNA, 1401 nt, Artificial Sequence
  derived and/or modified sequence opt1 from neuraminidase__InfluenzaB__AGX24352
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacaacaacgcccugcucaagaucaaguacggggaggcguacaccgacaccuaccacagcuacgccaagaacauccugcggacccaggaguccgccugcaacugcaucggcggggacugcuaccugaugaucacggacggccccgccagcggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccaacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccggggugaacaugacgcuguga

SEQ ID NO: 90849 - RNA, 1401 nt, Artificial Sequence; identical to SEQ ID NO: 90844
  derived and/or modified sequence opt1 from neuraminidase__InfluenzaB__AGX24363

SEQ ID NO: 90850 - RNA, 1401 nt, Artificial Sequence; identical to SEQ ID NO: 90848
  derived and/or modified sequence opt1 from neuraminidase__InfluenzaB__AGX24374

SEQ ID NO: 90851 - RNA, 1401 nt, Artificial Sequence
  derived and/or modified sequence opt1 from neuraminidase__InfluenzaB__AGX24385
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgacgaugccccuggacugcgcgaacgccagcaacgugcaggccgugaaccgguccgccaccaagggcgucacccuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccacgguggagaacuccaucuuccacauggccgccuggagcggcuccgccugccacgacgggcgcgaguggaccuacaucggcgucgacggcccggacagcaacgcccugcucaagaucaaguacggggaggcguacaccgacaccuaccacuccuacgccaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccaacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagacgaccuggcacagcgccgccaccgccaucuacugccugaugggguccggccagcugcucugggacaccgugacgggggugaacaugacccuguga

SEQ ID NO: 90852 - RNA, 1401 nt, Artificial Sequence
  derived and/or modified sequence opt1 from neuraminidase__InfluenzaB__AGX24396
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacaccgccgagauccggcugaugugcacggagaccuaccucgacaccccgcgccccaacgacggcuccaucaccgggcccugcgagagcgacggcgacaagggcuccgggggcaucaagggcggguucgugcaccagcggauggccagcaagaucgggcgcugguacucccggacgaugagcaagaccaagcgcaugggcaugggccuguacgugaaguacgacggggaccccuggaccgacuccggcgcgcuggcccucagcggggucaugguguccaucgaggagccgggcugguacagcuucggguucgagaucaaggacaagaagugcgacgugcccugcaucggcaucgagaugguccacgacggcgggaagaccacguggcacuccgccgccaccgccaucuacugccugaugggcagcgggcagcugcucugggacaccgugaccggcguggacauggcgcuguga

SEQ ID NO: 90853 - RNA, 1401 nt, Artificial Sequence; identical to SEQ ID NO: 90852
  derived and/or modified sequence opt1 from neuraminidase__InfluenzaB__AGX24407

SEQ ID NO: 90854 - RNA, 1401 nt, Artificial Sequence; identical to SEQ ID NO: 89825
  derived and/or modified sequence opt1 from neuraminidase__InfluenzaB__AGX24418

SEQ ID NO: 90855 - RNA, 1401 nt, Artificial Sequence; identical to SEQ ID NO: 89796
  derived and/or modified sequence opt1 from neuraminidase__InfluenzaB__AGX24429

SEQ ID NO: 90856 - RNA, 1401 nt, Artificial Sequence
  derived and/or modified sequence opt1 from neuraminidase__InfluenzaB__AGX24440
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggcacgaccgagugcaagcacuucgcccugacccacuacgccgcccagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggccccgacagcaacgcgcugcucaagaucaaguacggggaggccuacaccgacaccuaccacuccuacgccaagaacauccugcggacgcaggagagcgccugcaacugcaucggcggggacugcuaccugaugaucaccgacggcccggccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacacggccgagauccggcugaugugcaccgagaccuaccucgacacgccccgcccgaacgacggcuccaucaccgggcccugcgagagcgacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccggcgcgcuggcccucagcggggucaugguguccaucgaggagcccggcugguacagcuucggguucgagaucaaggacaagaagugcgacgugccgugcaucggcaucgagaugguccacgacggcgggaagacgaccuggcacuccgccgccaccaccaucuacugccugaugggcagcgggcagcugcucugggacacggugaccggcguggacauggcccuguga

SEQ ID NO: 90857 - RNA, 1401 nt, Artificial Sequence; identical to SEQ ID NO: 90420
  derived and/or modified sequence opt1 from neuraminidase__InfluenzaB__AGX24451

SEQ ID NO: 90858 - RNA, 1401 nt, Artificial Sequence
  derived and/or modified sequence opt1 from neuraminidase__InfluenzaB__AGX24462
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacuacgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcaucuccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgugaaguacgacggggaccccuggaccgacagcgaggcgcuggcccucuccggcgucaugaucagcauggaggagccggggugguacuccuucggcuucgagaucaaggacaagaagugcgacgugcccugcaucgggaucgagauggugcacgacggcggcaagaccacguggcacagcgccgccaccgccaucuacugccugaugggguccggccagcugcucugggacaccgucaccgggguggacauggcgcuguga

SEQ ID NO: 90859 - RNA, 1401 nt, Artificial Sequence; identical to SEQ ID NO: 90858
  derived and/or modified sequence opt1 from neuraminidase__InfluenzaB__AGX24473

SEQ ID NO: 90860 - RNA, 1401 nt, Artificial Sequence
  derived and/or modified sequence opt1 from neuraminidase__InfluenzaB__AGX24484
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacggcuacaccgccaagcggcccuucgugaagcugaacgucgagaccgacaccgccgagauccgccugaugugcacggagaccuaccucgacaccccgcggcccaacgacggguccaucaccggccccugcgagagcgacggcgacaagggguccggcgggaucaagggcggguucgugcaccagcgcauggccagcaagaucggccggugguacucccgcacgaugagcaagacccggcgcaugggcauggggcuguacgugaaguacgacggcgaccccuggaccgacuccgaggcgcuggcccucagcggggucaugguguccauggaggagccgggcugguacagcuucggguucgagaucaaggacaagaagugcgacgugcccugcaucggcaucgagaugguccacgacggcgggaagaccacguggcacuccgccgccaccgccaucuacugccugaugggcagcgggcagcugcucugggacaccgugaccggcguggacauggcgcuguga

SEQ ID NO: 90861 - RNA, 1401 nt, Artificial Sequence
  derived and/or modified sequence opt1 from neuraminidase__InfluenzaB__AGX24495
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacguccagguggugaaccgcuccgccgccaagggcgugacgcuccugcugcccgagcccgaguggaccuacccgcggcucagcugccccggguccaccuuccagaaggcccugcugaucagcccccaccgcuucggcgagaccaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccgucgagaacuccaucuuccacauggccgccuggagcggcuccgccugccacgacgggaaggaguggacguacaucggcguggacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagacccggcgcaugggcaugggccuguacgucaaguacgacggggaccccuggaccgacagcgaggcccuggcgcucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcccuguga

SEQ ID NO: 90862 - RNA, 1401 nt, Artificial Sequence; identical to SEQ ID NO: 90420
  derived and/or modified sequence opt1 from neuraminidase__InfluenzaB__AGX24506

SEQ ID NO: 90863 - RNA, 1401 nt, Artificial Sequence
  derived and/or modified sequence opt1 from neuraminidase__InfluenzaB__AGX24517
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaccaaggggaacuccgcgccccucaucauccgcgagccguucaucgccugcggccccacggagugcaagcacuucgcccugacccacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcgcacccaggagagcgccugcaacugcaucggcggggacugcuaccugaugaucacggacggccccgccagcggcguguccgagugccgguuccucaagauccgcgaggggcggaucaucaaggagaucuuccccaccggccgcgugaagcacaccgaggagugcacgugcggguucgcgagcaacaagaccaucgagugcgccugccgggacaacuccuacaccgccaagcgccccuucgucaagcugaacguggagaccgacaccgccgagauccggcugaugugcacggagaccuaccucgacaccccgcgccccaacgacggcagcaucaccgggcccugcgaguccgacggcgacaagggcagcgggggcaucaagggcggguucgugcaccagcggauggccuccaagaucgggcgcugguacagccggacgauguccaagaccaagcgcaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 90864 - RNA, 1401 nt, Artificial Sequence; identical to SEQ ID NO: 90420
  derived and/or modified sequence opt1 from neuraminidase__InfluenzaB__AGX24528

SEQ ID NO: 90865 - RNA, 1401 nt, Artificial Sequence; identical to SEQ ID NO: 90848
  derived and/or modified sequence opt1 from neuraminidase__InfluenzaB__AGX24539

SEQ ID NO: 90866 - RNA, 1401 nt, Artificial Sequence
  derived and/or modified sequence opt1 from neuraminidase__InfluenzaB__AGX24550
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugauccccgagcccgaguggaccuacccgcggcugagcugccccggguccaccuuccagaaggcgcuccugaucagcccccaccgcuucggcgagaccaaggggaacuccgcgccccugaucauccgggagccguucaucgccugcggccccacggagugcaagcacuucgcccucacccacuacgccgcccagcccggcggguacuacaacggcacccgcgaggaccggaacaagcugcgccaccugaucagcgugaagcucgggaagauccccaccguggagaacuccaucuuccacauggccgccuggagcggcuccgccugccacgacgggaaggaguggacguacaucggcgucgacggcccggacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcucaacgucgagaccgacaccgccgagauccgccugaugugcacggagaccuaccuggacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccucuacgugaaguacgacggggaccccuggaccgacagcgaggcgcuggcccuguccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccgggguggacauggcgcucuga

SEQ ID NO: 90867 - RNA, 1401 nt, Artificial Sequence; identical to SEQ ID NO: 90858
  derived and/or modified sequence opt1 from neuraminidase__InfluenzaB__AGX24561

SEQ ID NO: 90868 - RNA, 1401 nt, Artificial Sequence; identical to SEQ ID NO: 89825
  derived and/or modified sequence opt1 from neuraminidase__InfluenzaB__AGX24572

SEQ ID NO: 90869 - RNA, 1401 nt, Artificial Sequence
  derived and/or modified sequence opt1 from neuraminidase__InfluenzaB__AGX24583
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagacccggcgcaugggcaugggccuguacgugaaguacgacggggaccccuggaccgacagcggcgcgcuggcccucuccggggucauggugagcaucgaggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcguggacauggcgcuguga

SEQ ID NO: 90870 - RNA, 1401 nt, Artificial Sequence; identical to SEQ ID NO: 90420
  derived and/or modified sequence opt1 from neuraminidase__InfluenzaB__AGX24594

SEQ ID NO: 90871 - RNA, 1401 nt, Artificial Sequence; identical to SEQ ID NO: 90420
  derived and/or modified sequence opt1 from neuraminidase__InfluenzaB__AGX24605

SEQ ID NO: 90872 - RNA, 1401 nt, Artificial Sequence; identical to SEQ ID NO: 90420
  derived and/or modified sequence opt1 from neuraminidase__InfluenzaB__AGX24616

SEQ ID NO: 90873 - RNA, 1401 nt, Artificial Sequence; identical to SEQ ID NO: 90844
  derived and/or modified sequence opt1 from neuraminidase__InfluenzaB__AGX24627

SEQ ID NO: 90874 - RNA, 1401 nt, Artificial Sequence; identical to SEQ ID NO: 90420
  derived and/or modified sequence opt1 from neuraminidase__InfluenzaB__AGX24638

SEQ ID NO: 90875 - RNA, 1401 nt, Artificial Sequence
  derived and/or modified sequence opt1 from neuraminidase__InfluenzaB__AGX24660
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugaccuacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccggggugaacaugacgcuguga

SEQ ID NO: 90876 - RNA, 1401 nt, Artificial Sequence
  derived and/or modified sequence opt1 from neuraminidase__InfluenzaB__AGX24671
augcugcccagcaccauccagacccucacgcuguuccugaccuccggcggggugcuccugcugcucuacgucagcgccucccugagcuaccugcucuacuccgacauccugcugaaguucagccagaccgagaucaccgccccgaucaugccccucgacugcgcgaacgccuccaacgugcaggccgugaaccgcagcgccgccaagggcgucacgcugcugcuccccgagcccgaguggaccuacccgcggcuguccugccccgggagcaccuuccagaaggcgcugcucaucagcccccaccgcuucggcgagaccaaggggaacuccgcgccccugaucauccgggagccguucaucgccugcggccccacggagugcaagcacuucgcccugacccacuacgccgcccagcccggcggguacuacaacggcacccgcgaggaccggaacaagcuccgccaccugaucuccgugaagcuggggaagauccccaccguggagaacagcaucuuccacauggccgccugguccggcagcgccugccacgacgggaaggaguggacguacaucggcgucgacggcccggacuccaacgcgcuccugaagaucaaguacggggaggccuacaccgacaccuaccacagcuacgccaagaacauccugcggacccaggaguccgccugcaacugcaucggcggggacugcuaccucaugaucacggacggccccgccagcggcaucagcgagugccgcuuccugaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacaccgccgagauccgccucaugugcacggagaccuaccuggacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcgcucgcccugagcggcgucaugguguccauggaggagccggggugguacagcuucggcuucgagaucaaggacaagaagugcgacauccccugcaucgggaucgagauggugcacgacggcggcaagaccacguggcacuccgccgccaccgccaucuacugccugauggggagcggccagcuccugugggacaccgucaccgggguggacauggcgcuguga

SEQ ID NO: 90877 - RNA, 1401 nt, Artificial Sequence
  derived and/or modified sequence opt1 from neuraminidase__InfluenzaB__AGX24682
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccugguccucuccggcgugauggugagcauggaggagccggggugguacuccuucggcuucgagaucaaggacaagaagugcgacguccccugcaucgggaucgagauggugcacgacggcggcaagaccacguggcacagcgcggccaccgccaucuacugccugaugggguccggccagcugcucugggacaccgugaccggggucaacaugacgcuguga

SEQ ID NO: 90878 - RNA, 1401 nt, Artificial Sequence; identical to SEQ ID NO: 90420
  derived and/or modified sequence opt1 from neuraminidase__InfluenzaB__AGX24693

SEQ ID NO: 90879 - RNA, 1401 nt, Artificial Sequence; identical to SEQ ID NO: 90420
  derived and/or modified sequence opt1 from neuraminidase__InfluenzaB__AGX24704

SEQ ID NO: 90880 - RNA, 1401 nt, Artificial Sequence; identical to SEQ ID NO: 90420
  derived and/or modified sequence opt1 from neuraminidase__InfluenzaB__AGX24715

SEQ ID NO: 90881 - RNA, 1401 nt, Artificial Sequence
  derived and/or modified sequence opt1 from neuraminidase__InfluenzaB__AGX24737
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggcacgaccgagugcaagcacuucgcccugacccacuacgccgcccagcccggcggguacuacaacggcacccgcgaggaccggaacaagcugcgccaccucaucagcgugaagcuggggaagauccccacgguggagaacuccaucuuccacauggccgccuggagcggcuccgccugccacgacgggaaggaguggaccuacaucggcgucgacggccccgacagcaacgcgcugcucaagaucaaguacggggaggccuacaccgacaccuaccacuccuacgccaagaacauccugcggacgcaggagagcgccugcaacugcaucggcggggacugcuaccugaugaucaccgacggcccggccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgugaagcugaacgucgagaccgacacggccgagauccggcugaugugcaccgagaccuaccucgacacgccccgcccgaacgacggcuccaucaccgggcccugcgagagcgacggcgacaagggcuccgggggcaucaagggcggguucgugcaccagcggauggccagcaagaucgggcgcugguacucccggaccaugagcaagaccaagcgcaugggcaugggccuguacgugaaguacgacggggaccccuggaccgacuccggcgcgcuggcccucagcggggucaugguguccaucgaggagcccggcugguacagcuucggguucgagaucaaggacaagaagugcgacgugccgugcaucggcaucgagaugguccacgacggcgggaagacgaccuggcacuccgccgccaccgccaucuacugccugaugggcagcgggcagcugcucugggacaccgugacgggcguggacauggcgcuguga

SEQ ID NO: 90882 - RNA, 1401 nt, Artificial Sequence
  derived and/or modified sequence opt1 from neuraminidase__InfluenzaB__AGX24748
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggccgcuacuacaacgggacccgggaggaccgcaacaagcugcggcaccucaucagcgugaagcugggcaagauccccaccguggagaacuccaucuuccacauggccgccuggagcggguccgccugccacgacggcaaggaguggacguacaucggggucgacggcccggacagcaacgcgcugcucaagaucaaguacggcgaggccuacaccgacaccuaccacuccuacgccaagaacauccugcgcacccaggagagcgccugcaacugcaucgggggcgacugcuaccugaugaucacggacgggcccgccagcggcaucuccgagugccgguuccucaagauccgcgagggccggaucaucaaggagaucuuccccaccgggcgcgugaagcacaccgaggagugcacgugcggcuucgcgagcaacaagaccaucgagugcgccugccgggacaacuccuacaccgccaagcgccccuucgugaagcugaacgucgagaccgacaccgccgagauccggcugaugugcacggagaccuaccucgacaccccgcgccccaacgacgggagcaucaccggccccugcgaguccgacggggacaagggcagcggcgggaucaagggcggguucgugcaccagcggauggccuccaagaucggccgcugguacagccggacgauguccaagaccaagcgcauggggaugggccuguacgugaaguacgacggcgaccccuggaccgacagcgaggcgcuggcccucuccggggucauggugagcauggaggagccgggcugguacuccuucggguucgagaucaaggacaagaagugcgacgugcccugcaucggcaucgagaugguccacgacgggggcaagaccacguggcacagcgccgccaccgccguguacugccugaugggcuccgggcagcugcucugggacaccgugaccggcgucgacauggcgcuguga

SEQ ID NO: 90883 - RNA, 1401 nt, Artificial Sequence
  derived and/or modified sequence opt1 from neuraminidase__InfluenzaB__AGX24759
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacauccccugcaucgggaucgagauggugcacgacggcggcaagaccacguggcacagcgccgccaccgccaucuacugccugaugggguccggccagcugcucugggacaccgucaccgggguggacauggcgcuguga

SEQ ID NO: 90884 - RNA, 1401 nt, Artificial Sequence; identical to SEQ ID NO: 90420
  derived and/or modified sequence opt1 from neuraminidase__InfluenzaB__AGX24770

SEQ ID NO: 90885 - RNA, 1401 nt, Artificial Sequence; identical to SEQ ID NO: 90882
  derived and/or modified sequence opt1 from neuraminidase__InfluenzaB__AGX24781

SEQ ID NO: 90886 - RNA, 1401 nt, Artificial Sequence; identical to SEQ ID NO: 89796
  derived and/or modified sequence opt1 from neuraminidase__InfluenzaB__AGX24792

SEQ ID NO: 90887 - RNA, 1401 nt, Artificial Sequence; identical to SEQ ID NO: 90844
  derived and/or modified sequence opt1 from neuraminidase__InfluenzaB__AGX24803

SEQ ID NO: 90888 - RNA, 1401 nt, Artificial Sequence; identical to SEQ ID NO: 90420
  derived and/or modified sequence opt1 from neuraminidase__InfluenzaB__AGX24814

SEQ ID NO: 90889 - RNA, 1401 nt, Artificial Sequence
  derived and/or modified sequence opt1 from neuraminidase__InfluenzaB__AGX24825
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcgaguacuacaacgggacccgcgaggaccggaacaagcugcgccaccucaucagcgugaagcugggcaagauccccaccguggagaacuccaucuuccacauggccgccuggagcggguccgccugccacgacggcaaggaguggacguacaucggggucgacggcccggacagcaacgcgcugcucaagaucaaguacggcgaggccuacaccgacaccuaccacuccuacgccaagaacauccugcggacccaggagagcgccugcaacugcaucgggggcgacugcuaccugaugaucacggacgggcccgccagcggcaucuccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccgacggggacaagggcagcggcgggaucaagggcggguucgugcaccagcgcauggccuccaagaucggccggugguacagccgcacgauguccaagacccggcgcauggggaugggccuguacgugaaguacgacggcgaccccuggaccgacagcgaggcgcuggcccucuccggggucauggugagcauggaggagccgggcugguacuccuucggguucgagaucaaggacaagaagugcgacgugcccugcaucggcaucgagaugguccacgacgggggcaagaccacguggcacagcgccgccaccgccaucuacugccugaugggcuccgggcagcugcucugggacaccgugaccggcguggacauggcgcuguga

SEQ ID NO: 90890 - RNA, 1401 nt, Artificial Sequence; identical to SEQ ID NO: 90420
  derived and/or modified sequence opt1 from neuraminidase__InfluenzaB__AGX24836

SEQ ID NO: 90891 - RNA, 1401 nt, Artificial Sequence
  derived and/or modified sequence opt1 from neuraminidase__InfluenzaB__AGX24847
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccguguacugccugaugggguccggccagcugcucugggacaccgugaccggggucaacaugacgcuguga

SEQ ID NO: 90892 - RNA, 1401 nt, Artificial Sequence; identical to SEQ ID NO: 89904
  derived and/or modified sequence opt1 from neuraminidase__InfluenzaB__AGX24858

SEQ ID NO: 90893 - RNA, 1401 nt, Artificial Sequence
  derived and/or modified sequence opt1 from neuraminidase__InfluenzaB__AGX24869
augcugcccagcaccauccagacccucacgcuguuccugaccuccggcggggugcuccugagccuguacgucuccgccagccucuccuaccugcuguacagcgacauccuccugaaguucucccgcaccgagaugaccgccccgaucaugccccugggcugcgcgaacgccagcaacgugcaggccgugaaccgguccgccacgaagggggucacccuccugcugcccgagcccgaguggaccuacccgcgccucagcugccccggcuccaccuuccagaaggcccugcugaucagcccccaccgguucggggagacgaagggcaacuccgcgccccucaucauccgcgagccguucaucgccugcggccccaaggagugcaagcacuucgcccugacccacuacgccgcgcagcccgggggcuacuacaacgggacccgggaggaccgcaacaagcugcggcaccucaucagcgugaagcugggcaagauccccaccguggagaacuccaucuuccacauggccgccuggagcggguccgccugccacgacggccgcgaguggacguacaucggcgucgacgggccggacagcaacgcccugcucaagaucaaguacggcgaggcguacaccgacaccuaccacuccuacgccaagaacauccugcggacccaggagagcgccugcaacugcaucgggggcgacugcuaccugaugaucacggacggccccgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcgugaacaugacgcuguga

SEQ ID NO: 90894 - RNA, 1401 nt, Artificial Sequence
  derived and/or modified sequence opt1 from neuraminidase__InfluenzaB__AGX24880
augcugcccagcaccauccagaugcucacccuguuccugacguccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccaccaagggcgucacgcuccugcugcccgagcccgaguggaccuacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacgcacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggaccuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccggggugaacaugacccuguga

SEQ ID NO: 90895 - RNA, 1401 nt, Artificial Sequence
  derived and/or modified sequence opt1 from neuraminidase__InfluenzaB__AGX24902
augcugcccagcaccauccagacccucacgcuguuccugaccuccggcggggugcuccugagccuguacgucuccgcccuccugagcuaccugcucuacuccgacauccugcugaaguucagccgcaccgagaucaccgccccgaucaugccccucgacugcgcgaacgccuccaacgugcaggccgugaaccggagcgccacgaagggcgucacccugcugcuccccgagcccgaguggaccuacccgcgccuguccugccccgggagcaccuuccagaaggcccugcucaucagcccccaccgguucggcgagaacaaggggaacuccgcgccccugaucauccgcgagccguucaucgccugcggccccaaggagugcaagcacuucgcccugacgcacuacgccgcgcagcccggcggguacuacaacggcacccgggaggaccgcaacaagcuccggcaccugaucuccgugaagcuggggaagauccccaccguggagaacagcaucuuccacauggccgccugguccggcagcgccugccacgacgggcgcgaguggaccuacaucggcgucgacggcccggacuccaacgcccuccugaagaucaaguacggggaggcguacacggacaccuaccacagcuacgccaagaacauccugcggacccaggaguccgccugcaacugcaucggcggggacugcuaccucaugaucaccgacggccccgccagcggcaucagcgagugccgcuuccugaagauccgggaggggcgcaucaucaaggagaucuuccccacgggccgggugaagcacaccgaggagugcacgugcggguucgccuccaacaagaccaucgagugcgcgugccgcgacaacaacuacaccgccaagcggcccuucgugaagcugaacgucgagaccgacaccgccgagauccgccucaugugcaccgagacguaccuggacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccucgcgcuguccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcuccugugggacaccgugaccggggugaacaugacccuguga

SEQ ID NO: 90896 - RNA, 1401 nt, Artificial Sequence; identical to SEQ ID NO: 89909
  derived and/or modified sequence opt1 from neuraminidase__InfluenzaB__AGX84846

SEQ ID NO: 90897 - RNA, 1401 nt, Artificial Sequence; identical to SEQ ID NO: 89964
  derived and/or modified sequence opt1 from neuraminidase__InfluenzaB__AGX84858

SEQ ID NO: 90898 - RNA, 1401 nt, Artificial Sequence; identical to SEQ ID NO: 89909
  derived and/or modified sequence opt1 from neuraminidase__InfluenzaB__AGX84869

SEQ ID NO: 90899 - RNA, 1401 nt, Artificial Sequence
  derived and/or modified sequence opt1 from neuraminidase__InfluenzaB__AGX84880
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugagccuggacugcgcgaacgccuccaacgugcaggccgugaaccgcagcgccaccaagggcgucaucuuccuccugcccgagcccgaguggaccuacccgcggcuguccugccccgggagcaccuuccagaaggcccuccugaucagcccccaccgcuucggcgagacgaaggggaacuccgcgccccugaucauccgggagccguucaucgccugcggccccaacgagugcaagcacuucgcccucacccacuacgccgcgcagcccggcggguacuacaacggcacccgcggggaccggaacaagcugcgccaccugaucuccgugaagcucggcaagauccccaccguggagaacagcaucuuccacauggccgccugguccgggagcgccugccacgacggcaaggaguggacguacaucggcgucgacgggccggacaacgacgcccugcugaaggugaaguacggcgaggcguacaccgacaccuaccacuccuacgccaacaagauccuccggacccaggagagcgccugcaacugcaucgggggcaacugcuaccugaugaucacggacggcagcgccuccggggugagcgagugccgcuuccugaagauccgggagggccgcaucaucaaggagaucuuccccaccgggcgggucaagcacaccgaggagugcacgugcggcuucgccuccaacaagaccaucgagugcgcgugccgcgacaacagcuacaccgccaagcggcccuucgugaagcucaacguggagaccgacaccgccgagauccgccugaugugcacggacaccuaccuggacacgccccggccggacgacggguccaucaccggccccugcgagagcaacggcgacaagggguccggcgggaucaagggcggguucguccaccagcgcauggagagcaagaucggccggugguacucccgcaccaugagcaagaccgagcggaugggcauggggcucuacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagaccuggcacuccgccgccaccgccaucuacugccugaugggcagcgggcagcuccugugggacacggucaccggcguggacauggcccuguga

SEQ ID NO: 90900 - RNA, 1401 nt, Artificial Sequence; identical to SEQ ID NO: 89909
  derived and/or modified sequence opt1 from neuraminidase__InfluenzaB__AGX84891

SEQ ID NO: 90901 - RNA, 1401 nt, Artificial Sequence; identical to SEQ ID NO: 89964
  derived and/or modified sequence opt1 from neuraminidase__InfluenzaB__AGX84902

SEQ ID NO: 90902 - RNA, 1401 nt, Artificial Sequence
  derived and/or modified sequence opt1 from neuraminidase__InfluenzaB__AGX84924
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacuacgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 90903 - RNA, 1401 nt, Artificial Sequence
  derived and/or modified sequence opt1 from neuraminidase__InfluenzaB__AGY46393
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccaccaacgugcaggccgugaaccgcagcgccaccaagggcgucacccuccugcugcccgagccggaguggacguacccccggcucuccugccccgggagcaccuuccagaaggcccugcugaucagcccccaccgcuucggcgagaucaaggggaacuccgcgccgcucaucauccgggagcccuucaucgccugcggccccaacgagugcaagcacuucgcccugacccacuacgccgcgcagcccggcggguacuacaacggcacccgcgaggaccggaacaagcugcgccaccucaucuccgugaagcuggggaagaucccgacgguggagaacagcaucuuccacauggccgccugguccggcagcgccugccacgacgggcgggaguggaccuacaucggcgucgacggccccgacuccaacgcccugcucaagaucaaguacggggaggcguacaccgacaccuaccacagcuacgccaagaacauccugcgcacgcaggaguccgccugcaacugcaucggcggggacugcuaccugaugaucaccgacggccccgccagcggcaucagcgagugccgguuccucaagauccgcgaggggcggaucaucaaggagaucuuccccaccggccgcgugaagcacaccgaggagugcacgugcggguucgccuccaacaagaccaucgagugcgcgugccgggacaacagcuacaccgccaagcgcccguucgugaagcugaacgucgagaccgacacggccgagauccggcugaugugcaccgagaccuaccucgacacgccccgccccaacgacggcuccaucaccgggcccugcgagagcaacggcgacaagggcuccgggggcaucaagggcggguucgugcaccagcggauggccagcaagaucgggcgcugguacucccggaccaugagcaagaccgagcgcaugggcaugggccuguacgugaaguacgacggggacccgugggccgacuccgacgcgcuggccuucagcggcgucaugguguccauggaggagcccgggugguacagcuucggcuucgagaucaaggacaagaagugcgacgugcccugcaucgggaucgagaugguccacgacggcggcaaggagaccuggcacuccgccgccacggccaucuacugccucauggggagcggccagcugcugugggacaccgugaccggggugaacauggcgcucuga

SEQ ID NO: 90904 - RNA, 1401 nt, Artificial Sequence
  derived and/or modified sequence opt1 from neuraminidase__InfluenzaB__AGY46397
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacacgccccgcccgaacgacgggagcaucaccggccccugcgaguccgacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaagaccaccuggcacagcgccgccacggccaucuacugccucaugggcuccgggcagcugcugugggacaccgucaccggcgugaacaugacccucuga

SEQ ID NO: 90905 - RNA, 1401 nt, Artificial Sequence
  derived and/or modified sequence opt1 from neuraminidase__InfluenzaB__AGY46399
augcugcccagcaccauccagacccucacgcuguuccugaccuccggcggggugcuccugagccuguacgucuccgccagccucuccuaccugcuguacagcgacauccuccugaaguucuccccgaccgagaucaucgcccccaccacgccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgcccguucgugaagcugaacgucgagaccgacacggccgagauccggcugaugugcaccgagaccuaccucgacacgccccgccccaacgacggcagcaucaccgggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggacccgugggccgacagcgaggcgcuggcccucuccggcgucauggugagcauggaggagcccgggugguacuccuucggcuucgagaucaaggacaagaagugcgacgugcccugcaucgggaucgagaugguccacgacggcggcaaggagaccuggcacagcgccgccacggccaucuacugccugaugggguccggccagcugcucugggacaccgugaccgggguggacauggcgcuguga

SEQ ID NO: 90906 - RNA, 1401 nt, Artificial Sequence
  derived and/or modified sequence opt1 from neuraminidase__InfluenzaB__AGY46401
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaagaacauccugcgcacgcaggagagcgccugcaacugcaucggcggggacugcuaccugaugaucaccgacggccccgccagcggcaucuccgagugccgguuccucaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgcccguucgugaagcugaacgucgagaccgacacggccgagauccggcugaugugcaccgagaccuaccucgacacgccccgccccaacgacggcagcaucaccgggcccugcgaguccaacggcgacaagggcagcgggggcaucaagggcggguucgugcaccagcggauggccuccaagaucgggcgcugguacagccggaccauguccaagaccaagcgcaugggcaugggccuguacgugaaguacgacggggacccgugggccgacagcgacgcgcuggccuucuccggcgucauggugagcaugaaggagcccgggugguacuccuucggcuucgagaucaaggacaagaagugcgacgugcccugcaucgggaucgagaugguccacgacggcggcaaggagaccuggcacagcgccgccacggccaucuacugccucaugggguccggccagcugcugugggacaccgugaccgggguggacauggcgcucuga

SEQ ID NO: 90907 - RNA, 1401 nt, Artificial Sequence; identical to SEQ ID NO: 89624
  derived and/or modified sequence opt1 from neuraminidase__InfluenzaB__AGZ59825

SEQ ID NO: 90908 - RNA, 1401 nt, Artificial Sequence; identical to SEQ ID NO: 89690
  derived and/or modified sequence opt1 from neuraminidase__InfluenzaB__AGZ59836

SEQ ID NO: 90909 - RNA, 1401 nt, Artificial Sequence; identical to SEQ ID NO: 90379
  derived and/or modified sequence opt1 from neuraminidase__InfluenzaB__AGZ59847

SEQ ID NO: 90910 - RNA, 1401 nt, Artificial Sequence
  derived and/or modified sequence opt1 from neuraminidase__InfluenzaB__AGZ59858
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcaagcgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 90911 - RNA, 1401 nt, Artificial Sequence
  derived and/or modified sequence opt1 from neuraminidase__InfluenzaB__AGZ59869
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggccgugcugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacggucgagaacuccaucuuccacauggccgccuggagcggguccgccugccacgacggcaaggaguggaccuacaucggcguggacgggcccgacaacaacgcccugcugaagaucaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcucuacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcuccugugggacaccgucaccggcguggacauggcgcuguga

SEQ ID NO: 90912 - RNA, 1401 nt, Artificial Sequence; identical to SEQ ID NO: 90408
  derived and/or modified sequence opt1 from neuraminidase__InfluenzaB__AGZ59880

SEQ ID NO: 90913 - RNA, 1401 nt, Artificial Sequence; identical to SEQ ID NO: 90852
  derived and/or modified sequence opt1 from neuraminidase__InfluenzaB__AGZ59891

SEQ ID NO: 90914 - RNA, 1401 nt, Artificial Sequence; identical to SEQ ID NO: 89969
  derived and/or modified sequence opt1 from neuraminidase__InfluenzaB__AGZ59902

SEQ ID NO: 90915 - RNA, 1401 nt, Artificial Sequence; identical to SEQ ID NO: 89969
  derived and/or modified sequence opt1 from neuraminidase__InfluenzaB__AGZ59913

SEQ ID NO: 90916 - RNA, 1401 nt, Artificial Sequence; identical to SEQ ID NO: 89969
  derived and/or modified sequence opt1 from neuraminidase__InfluenzaB__AGZ59924

SEQ ID NO: 90917 - RNA, 1401 nt, Artificial Sequence; identical to SEQ ID NO: 89969
  derived and/or modified sequence opt1 from neuraminidase__InfluenzaB__AGZ59935

SEQ ID NO: 90918 - RNA, 1401 nt, Artificial Sequence; identical to SEQ ID NO: 89969
  derived and/or modified sequence opt1 from neuraminidase__InfluenzaB__AGZ59946

SEQ ID NO: 90919 - RNA, 1401 nt, Artificial Sequence
  derived and/or modified sequence opt1 from neuraminidase__InfluenzaB__AGZ59957
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaagggcaccuggcacagcgccgccacggccaucuacugccucaugggguccggccagcugcugugggacaccgucaccggcguggacauggcccucuga

SEQ ID NO: 90920 - RNA, 1401 nt, Artificial Sequence; identical to SEQ ID NO: 89969
  derived and/or modified sequence opt1 from neuraminidase__InfluenzaB__AGZ59969

SEQ ID NO: 90921 - RNA, 1401 nt, Artificial Sequence; identical to SEQ ID NO: 89969
  derived and/or modified sequence opt1 from neuraminidase__InfluenzaB__AGZ59980

SEQ ID NO: 90922 - RNA, 1401 nt, Artificial Sequence; identical to SEQ ID NO: 89969
  derived and/or modified sequence opt1 from neuraminidase__InfluenzaB__AGZ59991

SEQ ID NO: 90923 - RNA, 1401 nt, Artificial Sequence; identical to SEQ ID NO: 89969
  derived and/or modified sequence opt1 from neuraminidase__InfluenzaB__AGZ60003

SEQ ID NO: 90924 - RNA, 1401 nt, Artificial Sequence
  derived and/or modified sequence opt1 from neuraminidase__InfluenzaB__AGZ60014
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgaggcgaaggggaacuccgcgccccucaucauccgcgagccguucaucgccugcggccccaacgagugcaagcacuucgcccugacccacuacgccgcccagcccggcggguacuacaacggcacccgcggggaccggaacaagcugcggcaccucaucagcgugaagcugggcaagauccccaccguggagaacuccaucuuccacauggccgccuggagcggguccgccugccacgacggcaaggaguggacguacaucggcgucgacgggccggacaacgacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccagaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcgcuggccuucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 90925 - RNA, 1401 nt, Artificial Sequence; identical to SEQ ID NO: 89903
  derived and/or modified sequence opt1 from neuraminidase__InfluenzaB__AGZ60025

SEQ ID NO: 90926 - RNA, 1401 nt, Artificial Sequence
  derived and/or modified sequence opt1 from neuraminidase__InfluenzaB__AGZ60037
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgagagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacaucgcccucuga

SEQ ID NO: 90927 - RNA, 1401 nt, Artificial Sequence; identical to SEQ ID NO: 90139
  derived and/or modified sequence opt1 from neuraminidase__InfluenzaB__AGZ60048

SEQ ID NO: 90928 - RNA, 1401 nt, Artificial Sequence; identical to SEQ ID NO: 90139
  derived and/or modified sequence opt1 from neuraminidase__InfluenzaB__AGZ60059

SEQ ID NO: 90929 - RNA, 1401 nt, Artificial Sequence
  derived and/or modified sequence opt1 from neuraminidase__InfluenzaB__AGZ60070
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugccccuggacugcgcgaacgccagcaacgugcaggccgugaaccacuccgccgccaagggcgucacccuccugcugcccgagcccgaguggaccuacccgcgccucagcugccccggguccacguuccagaaggcgcugcugaucagcccccaccgguucggcgagaccaaggggaacuccgcgccccucaucauccgcgagccguucaucgccugcggccccaaggagugcaagcacuucgcccugacccacuacgccgcccagcccggcggguacuacaacggcacccgggaggaccgcaacaagcugcggcaccucaucagcgugaagcuggggaagauccccacgguggagaacuccaucuuccacauggccgccuggagcggcuccgccugccacgacgggaaggaguggaccuacaucggcgucgacggcccggacagcaacgcgcugcucaagaucaaguacggggaggccuacaccgacaccuaccacuccuacgcccacaacauccugcgcacgcaggagagcgccugcaacugcaucggcgggaacugcuaccugaugaucaccgacggcagcgccuccggcaucagcgagugccgguuccucaagauccgcgaggggcggaucaucaaggagaucuuccccaccggccgcgugaagcacaccgaggagugcacgugcggguucgcgaacaacaagaccaucgagugcgccugccgggacaacuccuacaccgccaagcgccccuucgugaagcugaacgucgagaccgacacggccgagauccggcugaugugcaccgagaccuaccucgacacgccccgcccggacgacggcagcaucaccgggcccugcgaguccaacggcaacaagggcagcgggggcaucaagggcggguucgugcaccagcggauggccuccaagaucgggcgcugguacagccggaccauguccaagaccaagcgcaugggcaugggccuguacgugaaguacgacggggaccccuggaccgacagcgacgcgcuggucuucuccggcgugaugaucagcguggaggagcccgggugguacuccuucggcuucgagaucaaggacaagaagugcgacgucccgugcaucgggaucgagauggugcacgacggcggcaaggagacguggcacagcgccgccaccgccaucuacugccucaugggguccggccagcugcugugggacaccgugaccggggucaacaugacgcucuga

SEQ ID NO: 90930 - RNA, 1401 nt, Artificial Sequence; identical to SEQ ID NO: 89635
  derived and/or modified sequence opt1 from neuraminidase__InfluenzaB__AGZ60081

SEQ ID NO: 90931 - RNA, 1401 nt, Artificial Sequence; identical to SEQ ID NO: 90155
  derived and/or modified sequence opt1 from neuraminidase__InfluenzaB__AGZ60092

SEQ ID NO: 90932 - RNA, 1401 nt, Artificial Sequence; identical to SEQ ID NO: 90778
  derived and/or modified sequence opt1 from neuraminidase__InfluenzaB__AGZ60103

SEQ ID NO: 90933 - RNA, 1401 nt, Artificial Sequence; identical to SEQ ID NO: 89796
  derived and/or modified sequence opt1 from neuraminidase__InfluenzaB__AGZ60135

SEQ ID NO: 90934 - RNA, 1401 nt, Artificial Sequence; identical to SEQ ID NO: 89968
  derived and/or modified sequence opt1 from neuraminidase__InfluenzaB__AGZ60154

SEQ ID NO: 90935 - RNA, 1401 nt, Artificial Sequence
  derived and/or modified sequence opt1 from neuraminidase__InfluenzaB__AGZ60164
augcugcccagcaccacccagacgcucacccuguuccugaccuccggcggggugcuccugagccuguacgucuccgccagccucuccuaccugcuguacagcgacauccuccugaaguucucccagaccgagaucacggccccgaucaugccccuggacugcgcgaacgccagcaacgugcaggccgugaaccgcuccgccgccaagggcgucacccuccugcugcccgagcccgaguggaccuacccgcggcucagcugccccggguccaccuuccagaaggcgcugcugaucaacccccaccgcuucggcgagacgaaggggaacagcgcgccccucaucauccgggagccguucaucgccugcggccccaccgagugcaagcacuucgcccugacccacuacgccgcccagcccggcggguacuacaacggcacccgcgaggaccggaacaagcugcgccaccucaucuccgugaagcuggggaagauccccacgguggagaacagcaucuuccacauggccgccugguccggcagcgccugccacgacgggaaggaguggaccuacaucggcgucgacggcccggacuccaacgcgcugcucaagaucaaguacggggaggccuacaccgacaccuaccacagcuacgccaagaacauccugcggacgcaggaguccgccugcaacugcaucggcggggacugcuaccugaugaucaccgacggccccgccagcggcaucagcgagugccgcuuccucaagauccgggaggggcgcaucaucaaggagaucuuccccaccggccgggugaagcacaccgaggagugcacgugcggguucgcguccaacaagaccaucgagugcgccugccgcgacaacagcuacaccgccaagcggcccuucgugaagcugaacgucgagaccgacacggccgagauccgccugaugugcaccgagaccuaccucgacaccccgcggcccaacgacggcuccaucacggggcccugcgagagcgacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcgcuggcccucagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacggggguggacauggcgcuguga

SEQ ID NO: 90936 - RNA, 1401 nt, Artificial Sequence; identical to SEQ ID NO: 90848
  derived and/or modified sequence opt1 from neuraminidase__InfluenzaB__AGZ60176

SEQ ID NO: 90937 - RNA, 1401 nt, Artificial Sequence; identical to SEQ ID NO: 89825
  derived and/or modified sequence opt1 from neuraminidase__InfluenzaB__AGZ60187

SEQ ID NO: 90938 - RNA, 1401 nt, Artificial Sequence; identical to SEQ ID NO: 89825
  derived and/or modified sequence opt1 from neuraminidase__InfluenzaB__AGZ60198

SEQ ID NO: 90939 - RNA, 1401 nt, Artificial Sequence; identical to SEQ ID NO: 89825
  derived and/or modified sequence opt1 from neuraminidase__InfluenzaB__AGZ60210

SEQ ID NO: 90940 - RNA, 1401 nt, Artificial Sequence
  derived and/or modified sequence opt1 from neuraminidase__InfluenzaB__AGZ60221
augcugcccaccaccauccagacgcucacccuguuccugaccagcggcggggugcuccugucccuguacgucagcgccucccucagcuaccugcuguacuccgacauccuccugaaguucagccgcaccgagaucacggccccgaucaugccccuggacugcgcgaacgccuccaacgugcaggccgugaaccggagcgccaccaagggcgucacccuccugcugcccgagcccgaguggaccuacccgcgccucuccugccccgggagcacguuccagaaggcccugcugaucagcccccaccgguucggcgagaccaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucuccgugaagcuggggaagauccccacgguggagaacagcaucuuccacauggccgccugguccggcagcgccugccacgacgggcgcgaguggaccuacaucggcgucgacggcccggacuccaacgcccugcucaagaucaaguacggggaggcguacaccgacaccuaccacagcuacgccaagaacauccugcggacgcaggaguccgccugcaacugcaucggcggggacugcuaccugaugaucaccgacggccccgccagcggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccaacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagacgaccuggcacuccgccgccaccgccaucuacugccugauggggagcggccagcugcucugggacaccgugacgggggugaacaugacccuguga

SEQ ID NO: 90941 - RNA, 1401 nt, Artificial Sequence
  derived and/or modified sequence opt1 from neuraminidase__InfluenzaB__AGZ60272
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccaagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccugaugggguccggccagcugcucugggacaccgugaccgggguggacauggcgcuguga

SEQ ID NO: 90942 - RNA, 1398 nt, Artificial Sequence
  derived and/or modified sequence opt1 from neuraminidase__InfluenzaB__AHL91182
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaugucccucgacugcgcgaacgccagcaacgugcaggccgugaaccacuccgccaccaaggagaugaaguuccugccgcccgagcccgaguggacguacccccgccugagcugccagggcuccaccuuccagaaggcccuccugaucagcccccaccgguucggggaggcgaagggcaacuccgcgccccugaucauccgcgagccguucaucgccugcgggcccaaggagugcaagcacuucgcccucacccacuacgccgcccagcccggcggcuacuacaacgggacccgggaggaccgcaacaagcugcggcaccugaucagcgucaaccucggcaagauccccacgguggagaacuccaucuuccacauggccgccuggagcggguccgccugccacgacggccgcgaguggaccuacaucgggguggacggcccggacagcaacgcgcugaucaagaucaaguacggcgaggccuacaccgacaccuaccacuccuacgccaacaacauccugcggacgcaggagagcgccugcaacugcaucgggggcgacugcuaccucaugaucaccgacgggagcgccuccggcaucagcaagugccgcuuccugaagauccgggagggccgcaucaucaaggagaucuuccccaccgggcgggucgagcacaccgaggagugcacgugcggcuucgcguccaacaagaccaucgagugcgccugccgcgacaacagcuacaccgccaagcggcccuucgugaagcugaacguggagaccgacacggccgagauccgccucaugugcaccgagaccuaccuggacacgccccggccggacgacggguccaucaccggccccugcgagagcaacggggacaagggccgcggcggggucaagggcggguucgugcaccagcggauggccuccaagaucggccgcugguacagccggaccauguccaagaccaagcgcauggggauggagcuguacgugaaguacgacggcgaccccuggaccgacagcgacgcgcucgcccccuccggcgucauggugagcauggaggagccggggugguacuccuucggcuucgagaucaaggacaagaagugcgacgugcccugcaucgggaucgagaugguccacgacggcgggaagcggacguggcacagcgccgccaccgccaucuacugccugaugggcuccggccagcugcucugggacaccgugaccgggguggacauggcgcuguga

SEQ ID NO: 90943 - RNA, 1398 nt, Artificial Sequence
  derived and/or modified sequence opt1 from neuraminidase__InfluenzaB__AHL91193
augcugcccagcaccauccagacccucacgcuguuccugaccuccggcggggugcuccugagccuguacgucuccgcccuccugagcuaccugcucuacuccgacauccugcugaaguucagcccgaagaucaucgcccccaccaugucccucgacugcgcgaacgccagcaacgugcaggccgugaaccacuccgccaccaaggagaugaaguuccugcccagcgagcccgaguggacguacccgcgccuguccugccagggcagcaccuuccagaaggcccuccugaucagcccccaccgguucggggaggcgaagggcaacuccgcgccccugaucauccgcgagcccuucaucgccugcgggccgaaggagugcaagcacuucgcccucacccacuacgccgcccagcccggcggcuacuacaacgggacccgggaggaccgcaacaagcugcggcaccugaucuccgucaaccucggcaagauccccacgguggagaacagcaucuuccacauggccgccugguccgggagcgccugccacgacggccgcgaguggaccuacaucgggguggacggccccgacuccaacgcgcugaucaagaucaaguacggcgaggccuacaccgacaccuaccacagcuacgccaacaacauccugcggacgcaggagagcgccugcaacugcaucgggggcgacugcuaccucaugaucaccgacggguccgccagcggcaucuccaagugccgcuuccugaagauccgggagggccgcaucaucaaggagaucuucccgaccgggcgggucgagcacaccgaggagugcacgugcggcuucgcgagcaacaagaccaucgagugcgccugccgcgacaacuccuacaccgccaagcggcccuucgugaagcugaacguggagaccgacacggccgagauccgccucaugugcaccgagaccuaccuggacacgccccggcccgacgacgggagcaucaccggcccgugcgaguccaacggggacaagggccgcggcggggucaagggcggguucgugcaccagcggauggccagcaagaucggccgcugguacucccggaccaugagcaagaccaagcgcauggggauggagcuguacgugaaguacgacggcgaccccuggaccgacuccgacgcgcucgcccccagcggcgucaugguguccauggaggagcccgggugguacagcuucggcuucgagaucaaggacaagaagugcgacgugccgugcaucgggaucgagaugguccacgacggcgggaagcggacguggcacuccgccgccaccgccaucuacugccugaugggcagcggccagcugcucugggacaccgugaccgggguggacauggcgcuguga

SEQ ID NO: 90944 - RNA, 1398 nt, Artificial Sequence
  derived and/or modified sequence opt1 from neuraminidase__InfluenzaB__AHL91204
augcugcccagcaccauccagacccucacgcuguuccugaccuccggcggggugcuccugagccuguacgucuccgcccuccugagcuaccugcucuacuccgacgugcugcugaaguucagcccgaagaucaucgcccccaccaugucccucgacugcgcgaacgccagcaacgugcaggccgucaaccacuccgccaccgaggagaugacguuccugcugcccgagcccgaguggaccuacccgcgccucagcugccagggcuccaccuuccagaaggcccugcugaucagcccccaccgguucggggaggcgaagggcaacuccgcgccccucaucauccgcgagcccuucaucgccugcgggccgaaggagugcaagcacuucgcccugacccacuacgccgcccagcccggcggcuacuacaacgggacgcgggaggaccgcaacaagcugcggcaccucaucagcgugaaccugggcaagauccccaccguggagaacuccaucuuccacauggccgccuggagcggguccgccugccacgacggccgcgaguggaccuacaucggggucgacggccccgacagcaacgcgcugaucaagaucaaguacggcgaggccuacaccgacacguaccacuccuacgccaacaacauccuccggacccaggagagcgccugcaacugcaucgggggcgacugcuaccugaugaucaccgacgggagcgccuccggcaucagcaagugccgcuuccugaagauccgggagggccgcaucaucaaggagaucuucccgaccgggcggguggagcacacggaggagugcacgugcggcuucgcguccaacaagaccaucgagugcgccugccgcgacaacaucuacaccgccaagcggcccuucgugaagcucaacgucgagaccgacaccgccgagauccgccugaugugcaccgagaccuaccuggacacgccccggcccgacgacgggagcaucaccggcccgugcgaguccaacggggacaagggccacggcgggaucaagggcggguucgugcaccagcgcauggccagcaagaucggccggugguacucccgcaccaugagcaagaccaagcggauggggauggagcucuacgugaaguacgacggcgaccccuggacggacuccgacgcgcuggcccccagcggcgucaugguguccauggaggagcccgggugguacagcuucggcuucgagaucaaggacaagaagugcgacgugccgugcaucgggaucgagaugguccacgacggcgggaagaagaccuggcacuccgccgccaccgccaucuacugccugaugggcagcggccagcuccugugggacaccgugacggggguggacauggcgcuguga

SEQ ID NO: 90945 - RNA, 1398 nt, Artificial Sequence
  derived and/or modified sequence opt1 from neuraminidase__InfluenzaB__AHL91215
augcugcccagcaccauccagacccucacgcuguuccugaccuccggcggggugcuccugagccuguacgucuccacccuccugagcuaccugcucuacuccgacauccugcugaaguucagcccgaagaucaucgcccccaccacgucccucgacugcgccaacgcgagcaacgugcaggccgugaaccacuccgccaccaaggagaugaaguuccugcccaccgagcccgaguggaccuacccgcgccugagcugccagggcuccacguuccagaaggcccuccugaucagcccccaccgguucggggaggccaagggcaacuccgcgccccugaucauccgcgagcccuucaucgccugcgggccgaaggagugcaagcacuucgcccucacccacuacgccgcgcagcccggcggcuacuacaacgggacccgggaggaccgcaacaagcugcggcaccugaucagcgucaaccucggcaagauccccaccguggagaacuccaucuuccacauggccgccuggagcggguccgccugccacgacggccgcgaguggacguacaucgggguggacggccccgacagcaacgcccugaucaagaucaaguacggcgaggcguacaccgacaccuaccacuccuacgccaacaacauccugcggacccaggagagcgccugcaacugcaucgggggcgacugcuaccucaugaucacggacgggagcgccuccggcaucagcaagugccgcuuccugaagauccgggagggccgcaucaucaaggagaucuucccgaccgggcgggucgagcacaccgaggagugcacgugcggcuucgccuccaacaagaccaucgagugcgcgugccgcgacaacagcuacaccgccaagcggcccuucgugaagcugaacguggagaccgacaccgccgagauccgccucaugugcacggagaccuaccuggacacgccccggcccgacgacggguccaucaccggcccgugcgagagcaacggggacaagggcuccggcggggucaagggcggguucgugcaccagcgcaugaccagcaagaucggccggugguacucccgcaccaugagcaagaccaagcggauggggauggagcuguacgugaaguacgacggcgaccccuggaccgacuccgacgcccucgcccccagcggcgucaugguguccauggaggagcccgggugguacagcuucggcuucgagaucaaggacaagaagugcgacgugccgugcaucgggaucgagaugguccacgacggcgggaagcgcacguggcacuccgcggccaccgccaucuacugccugaugggcagcggccagcugcucugggacaccgugaccgggguggacauggcccuguga

SEQ ID NO: 90946 - RNA, 1401 nt, Artificial Sequence; identical to SEQ ID NO: 89717
  derived and/or modified sequence opt1 from neuraminidase__InfluenzaB__AHL91226

SEQ ID NO: 90947 - RNA, 1401 nt, Artificial Sequence; identical to SEQ ID NO: 89718
  derived and/or modified sequence opt1 from neuraminidase__InfluenzaB__AHL91237

SEQ ID NO: 90948 - RNA, 1401 nt, Artificial Sequence; identical to SEQ ID NO: 89718
  derived and/or modified sequence opt1 from neuraminidase__InfluenzaB__AHL91248

SEQ ID NO: 90949 - RNA, 1401 nt, Artificial Sequence; identical to SEQ ID NO: 89717
  derived and/or modified sequence opt1 from neuraminidase__InfluenzaB__AHL91259

SEQ ID NO: 90950 - RNA, 1401 nt, Artificial Sequence; identical to SEQ ID NO: 89717
  derived and/or modified sequence opt1 from neuraminidase__InfluenzaB__AHL91270

SEQ ID NO: 90951 - RNA, 1398 nt, Artificial Sequence; identical to SEQ ID NO: 89689
  derived and/or modified sequence opt1 from neuraminidase__InfluenzaB__AHL91281

SEQ ID NO: 90952 - RNA, 1401 nt, Artificial Sequence
  derived and/or modified sequence opt1 from neuraminidase__InfluenzaB__AHL91303
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggcgggaguggaccuacaucggcgucgacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucaacgagugccgguuccucaagauccgcgaggggcggaucaucaaggagaucuuccccaccggccgcguggagcacaccgaggagugcacgugcggguucgccagcaacaagaccaucgagugcgcgugccgggacaacuccuacaccgccaagcgccccuucgugaagcugaacgucgagaccgacacggccgagauccggcugaugugcaccgagaccuaccucgacaccccgcgccccgacgacggcagcaucacggggcccugcgaguccaacggcgacaagggcagcgggggcaucaagggcggguucgugcaccagcggauggccuccaagaucgggcgcugguacagccggaccauguccaagacccgccggaugggcaugggccuguacgugaaguacgacggggaccccuggaccgacagcgacgcccuggcgcucuccggcgucauggugagcauggaggagccggggugguacuccuucggcuucgagaucaaggacaagaagugcgacgugcccugcaucgggaucgagaugguccacgacggcggcaagaagacguggcacagcgccgccaccgccaucuacugccugaugggguccggccagcugcucugggacaccgugaccgggguggacauggcccuguga

SEQ ID NO: 90953 - RNA, 1401 nt, Artificial Sequence; identical to SEQ ID NO: 89718
  derived and/or modified sequence opt1 from neuraminidase__InfluenzaB__AHL91314

SEQ ID NO: 90954 - RNA, 1401 nt, Artificial Sequence; identical to SEQ ID NO: 89718
  derived and/or modified sequence opt1 from neuraminidase__InfluenzaB__AHL91325

SEQ ID NO: 90955 - RNA, 1401 nt, Artificial Sequence
  derived and/or modified sequence opt1 from neuraminidase__InfluenzaB__AHL91347
augcugcccagcaccauccagacccucacgcuguuccugaccuccggcggggugcuccugagccuguacgucuccgccagccucuccuaccugcuguacagcgacgugcuccugaaguucuccccgaccgagaucaccgcccccacgaugccccuggacugcgcgaacgccagcaacgugcaggccgucaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacggucgagaacuccaucuuccacauggccgccuggagcggcuccgccugccacgacgggcgggaguggaccuacaucggcguggacggccccgacagcaacgcccugcucaagaucaaguacggggaggcguacaccgacaccuaccacuccuacgccaacaacauccugcgcacgcaggagagcgccugcaacugcaucggcggggacugcuaccugaugaucaccgacggcagcgccuccggcaucagcgagugccgguuccucaagauccgcgaggggcggaucgugaaggagaucuuccccaccggccgcgucgagcacaccgaggagugcacgugcggguucgccuccaacaagaccaucgagugcgcgugccgggacaacagcuacaccgccaagcgccccuucgugaagcugaacguggagaccgacacggccgagauccggcugaugugcaccgagaccuaccucgacaccccgcgccccgaggacggcuccaucacggggcccugcgagagcaacggcgacaagggcuccgggggcaucaagggcggguucguccaccagcggauggccagcaagaucgggcgcugguacucccggaccaugagcaagaccaagcgcaugggcaugggccuguacgugaaguacgacggggaccccuggaccgacuccgacgcccuggcgcucagcggcgugauggucuccauggaggagccggggugguacagcuucggcuucgagaucaaggacaagaagugcgacgugcccugcaucgggaucgagauggugcacgacggcggcaaggagacguggcacuccgccgccaccgccaucuacugccugauggggagcggccagcugcucugggacaccgucaccgggguggacauggcccuguga

SEQ ID NO: 90956 - RNA, 1401 nt, Artificial Sequence; identical to SEQ ID NO: 90955
  derived and/or modified sequence opt1 from neuraminidase__InfluenzaB__AHL91358

SEQ ID NO: 90957 - RNA, 1401 nt, Artificial Sequence; identical to SEQ ID NO: 89693
  derived and/or modified sequence opt1 from neuraminidase__InfluenzaB__AHL91369

SEQ ID NO: 90958 - RNA, 1401 nt, Artificial Sequence; identical to SEQ ID NO: 89693
  derived and/or modified sequence opt1 from neuraminidase__InfluenzaB__AHL91380

SEQ ID NO: 90959 - RNA, 1401 nt, Artificial Sequence
  derived and/or modified sequence opt1 from neuraminidase__InfluenzaB__AHL91391
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccugaacugcgcgaacgccagcaacgugcaggccgugaaccgcuccgccacgaagggcgucacccucccccugccggagcccgaguggaccuacccccggcugagcugccccggguccaccuuccagaaggcccuccugaucagcccgcaccgcuucggcgagacgaaggggaacuccgcgccccugaucauccgggagcccuucaucgccugcggccccaaggagugcaagcacuucgcccucacccacuacgccgcgcagccgggcggguacuacaacggcacccgcgaggaccggaacaagcugcgccaccugaucagcgugaagcucgggaagauccccaccguggagaacuccaucuuccacauggccgccuggagcggcuccgccugccacgacgggcgggaguggacguacaucggcgucgacggccccgacaacaacgcccugcugaagaucaaguacggggaggcguacaccgacaccuaccacagcuacgccaacaacauccuccgcacccaggaguccgccugcaacugcaucggcggggacugcuaccugaugaucacggacggcagcgccagcggcaucuccgagugccgguuccugaagauccgcgaggggcggaucaucaaggagaucuuccccaccggccgcguggagcacaccgaggagugcacgugcggguucgccagcaacaagaccaucgagugcgcgugccgggacaacuccuacaccgccaagcgcccguucgugaagcucaacgucgagaccgacaccgccgagauccggcugaugugcacggagaccuaccuggacacgccccgccccgacgacggcagcaucaccgggcccugcgaguccaacggcgacaagggcagcgggggcaucaagggcggguucgugcaccagcggauggccuccaagaucgggcgcugguacagccggaccauguccaagaccaagcgcaugggcaugggccucuacgugaaguacgacggggacccguggaucgacagcgacgcccugacccuguccggcgucauggugagcauggaggagcccgggugguacuccuucggcuucgagaucaaggacaagaagugcgacgugcccugcaucgggaucgagaugguccacgacggcggcaagaccacguggcacagcgcggccaccgccaucuacugccucaugggguccggccagcugcugugggacaccgugaccgggguggacauggcccucuga

SEQ ID NO: 90960 - RNA, 1401 nt, Artificial Sequence
  derived and/or modified sequence opt1 from neuraminidase__InfluenzaB__AHL91413
augcugcccagcaccauccagacccucacgcuguuccugaccuccggcggggugcuccugagccuguacgucuccgccagccucuccuaccugcuguacagcgacauccuccugaaguucaccccgaccgagaucacggcccccaccaugccccuggacugcgcgaacgccuccaacgugcaggccgugaaccucagcgccaccaagggcgucacccugcugcuccccgagccggaguggacguacccccgccuguccugccccgggagcaccuuccagaaggcccugcucaucagcccccaccgguucggcgagaccaaggggaacuccgcgccgcugaucauccgcgagcccuucaucgccugcggccccaaggagugcaagcacuucgcccugacccacuacgccgcgcagcccggcggguacuacaacggcacgcgggaggaccgcaacaagcuccggcaccugaucuccgugaagcuggggaagaucccgaccguggagaacagcaucuuccacauggccgccugguccggcagcgccugccacgacgggaaggaguggaccuacaucggcgucgacggccccgacuccaacgcccuccugaagaucaaguacggggaggcguacaccgacacguaccacagcuacgccaacaacauccugcgcacccaggaguccgccugcaacugcaucggcgggaacugcuaccucaugaucaccgacggcagcgccagcggcaucuccgagugccgguuccugaagauccgcgaggggcggaucaucaaggagaucuuccccaccggccgcgugaagcacacggaggagugcacgugcggguucgccagcaacaagaccaucgagugcgcgugccgggacaacuccuacaccgccaagcgccccuucgugaagcugaacgucgagaccgacaccgccgagauccggcucaugugcaccgagaccuaccuggacacgccgcgccccgacgacggcagcaucaccgggcccugcgaguccaacggcaacaagggcagcgggggcaucaagggcggguucgugcaccagcggauggccuccaagaucgggcgcugguacagccggaccauguccaagaccaagcgcaugggcaugggccuguacgugaaguacgacggggaccccuggacggacagcgacgcccucgcgcuguccggcgucauggugagcauggaggagccggggugguacuccuucggcuucgagaucaaggacaagaagugcgacgugcccugcaucgggaucgagaugguccacgacggcggcaaggagaccuggcacagcgccgccaccgccaucuacugccugaugggguccggccagcuccugugggacaccgugacggggguggacauggcccuguga

SEQ ID NO: 90961 - RNA, 1401 nt, Artificial Sequence
  derived and/or modified sequence opt1 from neuraminidase__InfluenzaB__AHL91446
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgucaagcuggggaagaucccgacgguggagaacuccaucuuccacauggccgccuggagcggcuccgccugccacgacgggaaggaguggaccuacaucggcguggacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggucgagcacaccgaggagugcacgugcggguucgccuccaacaagaccaucgagugcgcgugccgcgacaacagcuacaccgccaagcggcccuucgugaagcugaacguggagaccgacacggccgagauccgccugaugugcaccgagaccuaccucgacaccccgcggcccgacgacggcuccaucacggggcccugcgagagcaacggcggcaagggguccggcgggaucaagggcggguucguccaccagcgcauggagagcaagaucggccggugguacucccgcaccaugagcaagaccaagcggaugggcauggggcuguacgugaaguacgacggcgaccccuggaccgacuccgacgcccuggcccucagcggggugauggucuccauggaggagccgggcugguacagcuucggguucgagaucaaggacaaggagugcgacgugcccugcaucggcaucgagauggugcacgacggcgggaaggagacguggcacuccgcggccaccgccaucuacugccugaugggcagcgggcagcugcucugggacaccgucaccggcgugaacauggcccuguga

SEQ ID NO: 90962 - RNA, 1401 nt, Artificial Sequence
  derived and/or modified sequence opt1 from neuraminidase__InfluenzaB__AHL91457
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccaucaugccccuggacugcgcgaacgccagcaacgugcaggccgugaaccgcuccgccacgaagggcgucacccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacacccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcaacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 90963 - RNA, 1401 nt, Artificial Sequence
  derived and/or modified sequence opt1 from neuraminidase__InfluenzaB__AHL91468
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccgugggggagccgggcugguacagcuucggguucgagaucaaggacaagaagugcgacguccccugcaucggcaucgagauggugcacgacggcgggaaggagacguggcacuccgccgccaccgccaucuacugccugaugggcagcgggcagcugcucugggacaccgugaccggcgucgacauggcccuguga

SEQ ID NO: 90964 - RNA, 1401 nt, Artificial Sequence
  derived and/or modified sequence opt1 from neuraminidase__InfluenzaB__AHL91479
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugcccagcgacugcgcgaacgccuccaacgugcaggccgugaaccgcagcgccaccaagggcgucacccugcuccugcccgagccggaguggaccuacccccggcuguccugccccgggagcacguuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcggggaccggaacaagcugcgccaccugaucuccgugaagcucggcaagaucccgacgguggagaacagcaucuuccacauggccgccugguccgggagcgccugccacgacggcaaggaguggaccuacaucggcgucgacgggcccgacuccaacgcccugcugaagaucaaguacggcgaggcguacaccgacaccuaccacagcuacgccaacaacauccuccggacgcaggagagcgccugcaacugcaucgggggcaacugcuaccugaugaucaccgacggcuccgccagcgggaucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcucaacgucgagaccgacacggccgagauccgccugaugugcaccgagaccuaccuggacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgaccccuggaccgacagcgacgcccuggcgcuguccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccucaugggcuccgggcagcugcugugggacaccgugaccggcguggacauggcccucuga

SEQ ID NO: 90965 - RNA, 1401 nt, Artificial Sequence
  derived and/or modified sequence opt1 from neuraminidase__InfluenzaB__AHL91501
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcgaggaccggaacaagcugcgccaccucaucagcgucaagcuggggaagaucccgacgguggagaacuccaucuuccacauggccgccuggagcggcuccgccugccacgacgggaaggaguggaccuacaucggcguggacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggucgagcacaccgaggagugcacgugcggguucgccuccaacaagaccaucgagugcgcgugccgcgacaacagcuacaccgccaagcggcccuucgugaagcugaacguggagaccgacacggccgagauccgccugaugugcaccgagaccuaccucgacaccccgcggcccgacgacggcuccaucacggggcccugcgagagcaacggcggcaagggguccggcgggaucaagggcggguucguccaccagcgcauggagagcaagaucggccggugguacucccgcaccaugagcaagaccaagcggaugggcauggggcuguacgugaaguacgacggcgaccccuggaccgacuccgacgcccuggcccucagcggggugauggucuccauggaggagccgggcugguacagcuucggguucgagaucaaggacaagaagugcgacgugcccugcaucggcaucgagauggugcacgacggcgggaaggagacguggcacuccgcggccaccgccaucuacugccugaugggcagcgggcagcugcucugggacaccgucaccggcgugaacauggcccuguga

SEQ ID NO: 90966 - RNA, 1401 nt, Artificial Sequence
  derived and/or modified sequence opt1 from neuraminidase__InfluenzaB__AHL91512
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccaucuuccagaaggcccugcugaucagcccccaccgcuucggcgagacgaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacagcaacgcccugcucaagaucaaguacggcgaggcguacaccgacaccuaccacuccuacgccaacaacauccugcggacccaggagagcgccugcaacugcaucgggggcaacugcuaccugaugaucacggacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccgacgacggguccaucaccggccccugcgagagcaacggcgacaagggguccggcgggaucaagggcggguucgugcaccagcgcauggccagcaagaucggccggugguacucccgcacgaugagcaagaccaagcggaugggcauggggcuguacgugaaguacgacggcgaccccuggaccgacuccgacgcccuggcgcucagcggggucaugguguccauggaggagccgggcugguacagcuucggguucgagaucaaggacaagaagugcgacgugcccugcaucggcaucgagaugguccacgacggcgggaaggagaccuggcacuccgccgccacggccaucuacugccugaugggcagcgggcagcugcucugggacaccgugaccggcguggacauggcccuguga

SEQ ID NO: 90967 - RNA, 1401 nt, Artificial Sequence
  derived and/or modified sequence opt1 from neuraminidase__InfluenzaB__AHL91523
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccaagcggaugggcauggggcuguacgugaaguacgacggcgaccccuggaccgacagcgacgcccuggcgcucuccggggucauggugagcauggaggagccgggcugguacuccuucggguucgagaucaaggacaagaagugcgacgugcccugcaucggcaucgagaugguccacgacggcgggaaggagacguggcacagcgccgccaccgccaucuacugccugaugggcuccgggcagcugcucugggacaccgugaccggcguggacauggcccuguga

SEQ ID NO: 90968 - RNA, 1401 nt, Artificial Sequence; identical to SEQ ID NO: 90965
  derived and/or modified sequence opt1 from neuraminidase__InfluenzaB__AHL91534

SEQ ID NO: 90969 - RNA, 1401 nt, Artificial Sequence
  derived and/or modified sequence opt1 from neuraminidase__InfluenzaB__AHL91545
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcggacgcaggagagcgccugcaacugcaucgggggcaacugcuaccugaugaucaccgacggcagcgccuccgggaucagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggguccaucacgggccccugcgagagcaacggcgacaagggguccggcgggaucaagggcggguucgugcaccagcgcaugaccagcaagaucggccggugguacucccgcaccaugagcaagaccaagcggaugggcauggggcuguacgugaaguacgacggcgaccccuggacggacuccgacgcccuggcccucagcggggucaugguguccauggaggagccgggcugguacagcuucggguucgagaucaaggacaagaagugcgacgugcccugcaucggcaucgagaugguccacgacggcgggaagggcaccuggcacuccgcggccaccgccaucuacugccugauggggagcggccagcugcucugggacaccgugacgggcguggacauggcccuguga

SEQ ID NO: 90970 - RNA, 1401 nt, Artificial Sequence; identical to SEQ ID NO: 90965
  derived and/or modified sequence opt1 from neuraminidase__InfluenzaB__AHL91556

SEQ ID NO: 90971 - RNA, 1401 nt, Artificial Sequence; identical to SEQ ID NO: 90965
  derived and/or modified sequence opt1 from neuraminidase__InfluenzaB__AHL91578

SEQ ID NO: 90972 - RNA, 1401 nt, Artificial Sequence; identical to SEQ ID NO: 89893
  derived and/or modified sequence opt1 from neuraminidase__InfluenzaB__AHL91589

SEQ ID NO: 90973 - RNA, 1401 nt, Artificial Sequence
  derived and/or modified sequence opt1 from neuraminidase__InfluenzaB__AHL91600
augcugcccagcaccauccagacccucacgcuguuccugaccaccggcggggugcuccugucccuguacgucagcgccucccucagcuaccugcuguacuccgacauccuccugaaguucagcccgaccgagaucacggcccccaccaugccccuggacugcgcgaacgccuccaacgugcaggccgugaaccgcagcgccaccaagggcgucaccuuccuccugcccgagccggaguggacguacccccggcuguccugccccgggagcaccuuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacgcgcggggaccggaacaagcugcgccaccugaucuccgugaagcucggcaagaucccgaccguggagaacagcaucuuccacauggccgccugguccgggagcgccugccacgacggcaaggaguggaccuacaucggcgucgacgggcccgacuccaacgcccugcugaagaucaaguacggcgaggcguacaccgacacguaccacagcuacgccaacaacauccuccggacccaggaguccgccugcaacugcaucgggggcaacugcuaccugaugaucaccgacggcagcgccagcgggaucuccgagugccgcuuccugaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgugaagcucaacgucgagaccgacaccgccgagauccgccugaugugcaccgagaccuaccuggacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccaagcggaugggcauggggcucuacgugaaguacgacggcgaccccuggacggacagcgacgcccuggcgcuguccggggucauggugagcauggaggagccgggcugguacuccuucggguucgagaucaaggacaagaagugcgacgugcccugcaucggcaucgagaugguccacgacggcgggaaggagaccuggcacagcgccgccaccgccaucuacugccucaugggcuccgggcagcugcugugggacaccgugacgggcguggacauggcccucuga

SEQ ID NO: 90974 - RNA, 1401 nt, Artificial Sequence; identical to SEQ ID NO: 90973
  derived and/or modified sequence opt1 from neuraminidase__InfluenzaB__AHL91611

SEQ ID NO: 90975 - RNA, 1401 nt, Artificial Sequence; identical to SEQ ID NO: 90965
  derived and/or modified sequence opt1 from neuraminidase__InfluenzaB__AHL91622

SEQ ID NO: 90976 - RNA, 1401 nt, Artificial Sequence; identical to SEQ ID NO: 90966
  derived and/or modified sequence opt1 from neuraminidase__InfluenzaB__AHL91633

SEQ ID NO: 90977 - RNA, 1401 nt, Artificial Sequence; identical to SEQ ID NO: 90966
  derived and/or modified sequence opt1 from neuraminidase__InfluenzaB__AHL91644

SEQ ID NO: 90978 - RNA, 1401 nt, Artificial Sequence
  derived and/or modified sequence opt1 from neuraminidase__InfluenzaB__AHL91655
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaaggaggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcgggcccaaggagugcaagcacuucgcccugacccacuacgccgcgcagcccggcggcuacuacaacgggacccgcggcgaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacagcaacgcccugcucaagaucaaguacggggaggcguacaccgacaccuaccacuccuacgccaacaacauccugcggacgcaggagagcgccugcaacugcaucggcgggaacugcuaccugaugaucaccgacggcagcgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacacggccgagauccgccugaugugcaccgagaccuaccucgacaccccgcggcccgacgacggcuccaucacggggcccugcgagagcaacggcgacaagggcuccgggggcaucaagggcggguucgugcaccagcgcauggccagcaagaucgggcggugguacucccgcaccaugagcaagaccaagcggaugggcaugggccuguacgugaaguacgacggggaccccuggaccgacuccgacgcccuggcgcucagcggcgucaugguguccauggaggagccggggugguacagcuucggcuucgagaucaaggacaagaagugcgacgugcccugcaucgggaucgagaugguccacgacggcggcaaggagacguggcacuccgccgccaccgccaucuacugccugauggggagcggccagcugcucugggacaccgugaccgggguggacauggcccuguga

SEQ ID NO: 90979 - RNA, 1401 nt, Artificial Sequence; identical to SEQ ID NO: 90965
  derived and/or modified sequence opt1 from neuraminidase__InfluenzaB__AHL91666

SEQ ID NO: 90980 - RNA, 1401 nt, Artificial Sequence; identical to SEQ ID NO: 90966
  derived and/or modified sequence opt1 from neuraminidase__InfluenzaB__AHL91677

SEQ ID NO: 90981 - RNA, 1401 nt, Artificial Sequence; identical to SEQ ID NO: 90967
  derived and/or modified sequence opt1 from neuraminidase__InfluenzaB__AHL91688

SEQ ID NO: 90982 - RNA, 1401 nt, Artificial Sequence; identical to SEQ ID NO: 89695
  derived and/or modified sequence opt1 from neuraminidase__InfluenzaB__AHL91699

SEQ ID NO: 90983 - RNA, 1401 nt, Artificial Sequence
  derived and/or modified sequence opt1 from neuraminidase__InfluenzaB__AHL91710
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaaggagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacagcaacgcccugcucaagaucaaguacggcgaggcguacaccgacaccuaccacuccuacgccaacaacauccugcgcacgcaggagagcgccugcaacugcaucgggggcaacugcuaccugaugaucaccgacggcagcgccuccgggaucagcgagugccgguuccucaagauccgcgagggccggaucaucaaggagaucuuccccaccgggcgcgugaagcacaccgaggagugcacgugcggcuucgccuccaacaagaccaucgagugcgcgugccgggacaacagcuacaccgccaagcgccccuucgugaagcugaacgucgagaccgacacggccgagauccggcugaugugcaccgagaccuaccucgacaccccgcgccccgacgacggguccaucacgggccccugcgagagcaacggcgacaagggguccggcgggaucaagggcggguucgugcaccagcggauggccagcaagaucggccgcugguacucccggaccaugagcaagaccaagcgcaugggcauggggcuguacgugaaguacgacggcgaccccuggaccgacuccgacgcccuggcgcucagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcugcucugggacaccgugaccggcguggacauggcccuguga

SEQ ID NO: 90984 - RNA, 1401 nt, Artificial Sequence; identical to SEQ ID NO: 89622
  derived and/or modified sequence opt1 from neuraminidase__InfluenzaB__AHL91721

SEQ ID NO: 90985 - RNA, 1401 nt, Artificial Sequence; identical to SEQ ID NO: 89690
  derived and/or modified sequence opt1 from neuraminidase__InfluenzaB__AHL91732

SEQ ID NO: 90986 - RNA, 1401 nt, Artificial Sequence; identical to SEQ ID NO: 89622
  derived and/or modified sequence opt1 from neuraminidase__InfluenzaB__AHL91743

SEQ ID NO: 90987 - RNA, 1401 nt, Artificial Sequence
  derived and/or modified sequence opt1 from neuraminidase__InfluenzaB__AHL91754
augcugcccagcaccauccagacccucacgcugcugcucaccuccggcggggugcugcugagccucuacgucuccgccagccuguccuaccugcucuacagcgacauccugcugaaguucuccccgaccgagaucaccgcccccacgaugccccucgacugcgcgaacgccagcaacgugcaggccgugaaccgcuccgccaccaagggcgucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacagcaacgcccuccugaagaucaaguacggcgaggcguacaccgacaccuaccacuccuacgccaacaacauccugcggacgcaggagagcgccugcaacugcaucgggggcaacugcuaccucaugaucaccgacggcagcgccuccgggaucagcgagugccgcuuccugaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgugaagcugaacgucgagaccgacacggccgagauccgccucaugugcaccgagaccuaccuggacaccccgcggcccgacgacggguccaucacgggccccugcgagagcaacggcgacaagggguccggcgggaucaagggcggguucgugcaccagcgcauggccagcaagaucggccggugguacucccgcaccaugagcaagaccaagcggaugggcauggggcuguacgugaaguacgacggcgaccccuggaccgacuccgacgcccucgcgcugagcggggucaugguguccauggaggagccgggcugguacagcuucggguucgagaucaaggacaagaagugcgacgugcccugcaucggcaucgagaugguccacgacggcgggaaggagacguggcacuccgccgccaccgccaucuacugccugaugggcagcgggcagcuccugugggacaccgugaccggcguggacauggcccuguga

SEQ ID NO: 90988 - RNA, 1401 nt, Artificial Sequence; identical to SEQ ID NO: 89622
  derived and/or modified sequence opt1 from neuraminidase__InfluenzaB__AHL91765

SEQ ID NO: 90989 - RNA, 1401 nt, Artificial Sequence
  derived and/or modified sequence opt1 from neuraminidase__InfluenzaB__AHL91776
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaccuccaucuuccacauggccgccuggagcggguccgccugccacgacggcaaggaguggaccuacaucggcgucgacgggcccgacaacaacgcccugcucaagaucaaguacggcgaggcguacaccgacacguaccacagcuacgccaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgucaagcugaacguggagaccgacaccgccgagauccgccugaugugcaccgagaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggcccucuccggggugauggugagcauggaggagccgggcugguacuccuucggguucgagaucaaggacaagaagugcgacguccccugcaucggcaucgagauggugcacgacggcgggaaggagacguggcacagcgccgccaccgccaucuacugccugaugggcuccgggcagcugcucugggacaccgugaccggcgucgacauggcgcuguga

SEQ ID NO: 90990 - RNA, 1401 nt, Artificial Sequence; identical to SEQ ID NO: 90989
  derived and/or modified sequence opt1 from neuraminidase__InfluenzaB__AHL91787

SEQ ID NO: 90991 - RNA, 1401 nt, Artificial Sequence; identical to SEQ ID NO: 90989
  derived and/or modified sequence opt1 from neuraminidase__InfluenzaB__AHL91798

SEQ ID NO: 90992 - RNA, 1401 nt, Artificial Sequence; identical to SEQ ID NO: 89626
  derived and/or modified sequence opt1 from neuraminidase__InfluenzaB__AHL91809

SEQ ID NO: 90993 - RNA, 1401 nt, Artificial Sequence
  derived and/or modified sequence opt1 from neuraminidase__InfluenzaB__AHL91820
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugauggugaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucguccaccagcgcauggccuccaagaucggccggugguacagccgcaccauguccaagaccgagcggaugggcauggggcuguacgugaaguacgacggcgaccccugggccgacagcgacgcgcuggcccucuccggggugauggucagcauggaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcugcucugggacaccgucaccggcguggacauggcgcuguga

SEQ ID NO: 90994 - RNA, 1401 nt, Artificial Sequence
  derived and/or modified sequence opt1 from neuraminidase__InfluenzaB__AHL91831
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgagaccuaccucgacaccccgcggcccgacgacgggagcaucacgggccccugcgaguccaacggcgacaaggggagcggcgggaucaagggcggguucgugcaccagcgcaugaccuccaagaucggccggugguacagccgcaccauguccaagaccgagcggaugggcauggggcuguacgucaaguacgacggcgaccccugggccgacagcgacgcccuggcgcucuccggggugauggugagcauggaggagccgggcugguacuccuucggguucgagaucaaggacaagaagugcgacguccccugcaucggcaucgagauggugcacgacggcgggaaggagacguggcacagcgccgccaccgccaucuacugccugaugggcuccgggcagcugcucugggacaccgugaccggcgucgacauggcccuguga

SEQ ID NO: 90995 - RNA, 1401 nt, Artificial Sequence; identical to SEQ ID NO: 90139
  derived and/or modified sequence opt1 from neuraminidase__InfluenzaB__AHL91842

SEQ ID NO: 90996 - RNA, 1401 nt, Artificial Sequence
  derived and/or modified sequence opt1 from neuraminidase__InfluenzaB__AHL91853
augcugcccagcaccauccagacccucacgcuguuccugaccuccggcggggugcuccugagccuguacgucuccgccagccucuccuaccugcuguacagcgacauccuccugaaguucuccaccaccgagaucacggccccgaccaugcccagcgacugcgcgaacgccuccaacgugcaggccgugaaccgcagcgccaccaagggcgucacccugcuccugcccgagcccgaguggacguacccgcggcuguccugccccgggagcaccuuccagaaggcccuccugaucagcccccaccgcuucggcgagaccaaggggaacuccgcgccccugaucauccgggagccguucaucgccugcggccccaaggagugcaagcacuucgcccucacccacuacgccgcgcagcccggcggguacuacaacggcacgcgcgaggaccggaacaagcugcgccaccugaucuccgugaagcucgggaagauccccaccguggagaacagcaucuuccacauggccgccugguccggcagcgccugccacgacgggaaggaguggaccuacaucggcgucgacggcccggacuccaacgcccugcugaagaucaaguacggggaggcguacaccgacacguaccacagcuacgccaacaacauccuccggacccaggagagcgccugcaacugcaucggcgggaacugcuaccugaugaucaccgacggcuccgccagcggcaucuccgagugccgcuuccugaagauccgggaggggcgcaucaucaaggagaucuuccccaccggccgggugaagcacacggaggagugcacgugcggguucgccagcaacaagaccaucgagugcgcgugccgcgacaacuccuacaccgccaagcggcccuucgugaagcucaacgucgagaccgacaccgccgagauccgccugaugugcaccgagaccuaccuggacacgccccggccggacgacggcagcaucaccgggcccugcgaguccaacggcaacaagggcagcgggggcaucaagggcggguucgugcaccagcgcauggccuccaagaucgggcggugguacagccgcaccauguccaagaccaagcggaugggcaugggccucuacgugaaguacgacggggaccccuggacggacagcgacgcccuggcgcuguccggcgucauggugagcauggaggagcccgggugguacuccuucggcuucgagaucaaggacaagaagugcgacgugccgugcaucgggaucgagaugguccacgacggcggcaaggagaccuggcacagcgccgccaccgccaucuacugccucaugggguccggccagcugcugugggacaccgugacggggguggacauggcccucuga

SEQ ID NO: 90997 - RNA, 1401 nt, Artificial Sequence; identical to SEQ ID NO: 90137
  derived and/or modified sequence opt1 from neuraminidase__InfluenzaB__AHL91864

SEQ ID NO: 90998 - RNA, 1401 nt, Artificial Sequence; identical to SEQ ID NO: 90137
  derived and/or modified sequence opt1 from neuraminidase__InfluenzaB__AHL91875

SEQ ID NO: 90999 - RNA, 1401 nt, Artificial Sequence; identical to SEQ ID NO: 89894
  derived and/or modified sequence opt1 from neuraminidase__InfluenzaB__AHL91886

SEQ ID NO: 91000 - RNA, 1401 nt, Artificial Sequence; identical to SEQ ID NO: 89635
  derived and/or modified sequence opt1 from neuraminidase__InfluenzaB__AHL91897

SEQ ID NO: 91001 - RNA, 1401 nt, Artificial Sequence; identical to SEQ ID NO: 89635
  derived and/or modified sequence opt1 from neuraminidase__InfluenzaB__AHL91908

SEQ ID NO: 91002 - RNA, 1401 nt, Artificial Sequence
  derived and/or modified sequence opt1 from neuraminidase__InfluenzaB__AHL91919
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccacgaagggcgucacgccccuccugcccgagccggaguggaccuacccccggcugagcugccccggguccaccuuccagaaggcccuccugaucagcccccaccgcuucggcgagaccaaggggaacuccgcgccgcugaucauccgggagcccuucaucgccugcggccccaaggagugcaagcacuucgcccucacccacuacgccgcgcagcccggcggguacuacaacggcacccgcgaggaccggaacaagcugcgccaccugaucagcgugaagcucgggaagaucccgaccguggagaacuccaucuuccacauggccgccuggagcggcuccgccugccacgacgggcgggaguggacguacaucggcgucgacggccccgacagcaacgcccugcugaagaucaaguacggggaggcguacaccgacaccuaccacuccuacgccaagaacauccuccgcacccaggagagcgccugcaacugcaucggcggggacugcuaccugaugaucacggacggccccgccagcggcaucuccgagugccgguuccugaagauccgcgaggggcggaucaucaaggagaucuuccccaccggccgcgugaagcacaccgaggagugcacgugcggguucgccagcaacaagaccaucgagugcgcgugccgggacaacuccuacaccgccaagcgcccguucgugaagcucaacgucgagaccgacaccgccgagauccggcugaugugcacggagaccuaccuggacacgccccgccccaacgacggcagcaucaccgggcccugcgaguccaacggcgacaagggcagcgggggcaucaagggcggguucgugcaccagcggauggccuccaagaucgggcgcugguacagccggaccauguccaagaccaagcgcaugggcaugggccucuacgugaaguacgacggggacccguggaccgacagcgaggcccuggcgcuguccggcgucauggugagcauggaggagcccgggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccgggguggacauggcccucuga

SEQ ID NO: 91003 - RNA, 1401 nt, Artificial Sequence; identical to SEQ ID NO: 90697
  derived and/or modified sequence opt1 from neuraminidase__InfluenzaB__AHL91930

SEQ ID NO: 91004 - RNA, 1401 nt, Artificial Sequence; identical to SEQ ID NO: 89635
  derived and/or modified sequence opt1 from neuraminidase__InfluenzaB__AHL91941

SEQ ID NO: 91005 - RNA, 1401 nt, Artificial Sequence; identical to SEQ ID NO: 89635
  derived and/or modified sequence opt1 from neuraminidase__InfluenzaB__AHL91952

SEQ ID NO: 91006 - RNA, 1401 nt, Artificial Sequence; identical to SEQ ID NO: 89678
  derived and/or modified sequence opt1 from neuraminidase__InfluenzaB__AHL91963

SEQ ID NO: 91007 - RNA, 1401 nt, Artificial Sequence
  derived and/or modified sequence opt1 from neuraminidase__InfluenzaB__AHL91974
augcugcccagcaccauccagacccucacgcuguuccugaccuccggcggggugcuccugagccuguacgucuccgccagccucuccuaccugcuguacagcgacauccuccugaaguucuccccgaccgagaucaccacgcccaccaugccccuggacugcgccaacgcgagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgccugccgcgacaacuccuacaccgcgaagcggcccuucgucaagcugaacguggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcccuggcguucuccggggugauggugagcaugaaggagccgggcugguacuccuucggguucgagaucaaggacaagaagugcgacguccccugcaucggcaucgagauggugcacgacggcgggaaggagacguggcacagcgccgccaccgccaucuacugccucaugggcuccgggcagcugcugugggacaccgugaccggcgucgacauggcccucuga

SEQ ID NO: 91008 - RNA, 1401 nt, Artificial Sequence; identical to SEQ ID NO: 89678
  derived and/or modified sequence opt1 from neuraminidase__InfluenzaB__AHL91985

SEQ ID NO: 91009 - RNA, 1401 nt, Artificial Sequence; identical to SEQ ID NO: 89635
  derived and/or modified sequence opt1 from neuraminidase__InfluenzaB__AHL91995

SEQ ID NO: 91010 - RNA, 1401 nt, Artificial Sequence
  derived and/or modified sequence opt1 from neuraminidase__InfluenzaB__AHL92006
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcguggagauggugcacgacggcgggaaggagaccuggcacagcgccgccacggccaucuacugccucaugggcuccgggcagcugcugugggacaccgucaccggcguggacauggcgcucuga

SEQ ID NO: 91011 - RNA, 1401 nt, Artificial Sequence; identical to SEQ ID NO: 89643
  derived and/or modified sequence opt1 from neuraminidase__InfluenzaB__AHL92017

SEQ ID NO: 91012 - RNA, 1401 nt, Artificial Sequence; identical to SEQ ID NO: 89643
  derived and/or modified sequence opt1 from neuraminidase__InfluenzaB__AHL92028

SEQ ID NO: 91013 - RNA, 1401 nt, Artificial Sequence
  derived and/or modified sequence opt1 from neuraminidase__InfluenzaB__AHL92039
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaucuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacaacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 91014 - RNA, 1401 nt, Artificial Sequence; identical to SEQ ID NO: 89643
  derived and/or modified sequence opt1 from neuraminidase__InfluenzaB__AHL92050

SEQ ID NO: 91015 - RNA, 1401 nt, Artificial Sequence
  derived and/or modified sequence opt1 from neuraminidase__InfluenzaB__AHL92061
augcugcccagcaccacccagacgcucacccuguuccugaccuccggcggggugcuccugagccuguacgucuccgccagccucuccuaccugcuguacagcgacauccuccugaaguucuccccgaccgagaucacggcccccaccaugccccuggacugcgcgaacgccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacgcgcggggaccggaacaagcugcgccaccucaucagcgugaagcugggcaagaucccgaccguggagaacuccaucuuccacauggccgccuggagcggguccgccugccacgacggcaaggaguggaccuacaucggcgucgacgggcccgacaacaacgcccugcucaagaucaaguacggcgaggcguacaccgacacguaccacagcuacgccaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacacggaggagugcacgugcggcuucgccagcaacaagaccaucgagugcgcgugccgcgacaacuccuacaccgccaagcggcccuucgucaagcugaacguggagaccgacaccgccgagauccgccugaugugcaccgacaccuaccucgacacgccgcggcccgacgacgggagcaucaccggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagacguggcacagcgccgccaccgccaucuacugccucaugggcuccgggcagcugcugugggacaccgugaccggcgucgacauggcgcucuga

SEQ ID NO: 91016 - RNA, 1401 nt, Artificial Sequence
  derived and/or modified sequence opt1 from neuraminidase__InfluenzaB__AHL92072
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 91017 - RNA, 1401 nt, Artificial Sequence; identical to SEQ ID NO: 91016
  derived and/or modified sequence opt1 from neuraminidase__InfluenzaB__AHL92083

SEQ ID NO: 91018 - RNA, 1401 nt, Artificial Sequence; identical to SEQ ID NO: 91016
  derived and/or modified sequence opt1 from neuraminidase__InfluenzaB__AHL92094

SEQ ID NO: 91019 - RNA, 1401 nt, Artificial Sequence
  derived and/or modified sequence opt1 from neuraminidase__InfluenzaB__AHL92105
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaagggcggcgggggcaucaagggcggguucgugcaccagcgcauggccagcaagaucgggcggugguacucccgcaccaugagcaagaccgagcggauggggaugggccuguacgucaaguacgacggggaccccugggccgacuccgacgcgcuggccuucagcggcgugauggugucccucaaggagccggggugguacagcuucggcuucgagaucaaggacaagaagugcgacguccccugcaucggcaucgagauggugcacgacgggggcaaggagaccuggcacuccgccgccacggccaucuacugccugauggggagcggccagcugcucugggacaccgugaccggcgucgacauggcgcuguga

SEQ ID NO: 91020 - RNA, 1401 nt, Artificial Sequence; identical to SEQ ID NO: 89796
  derived and/or modified sequence opt1 from neuraminidase__InfluenzaB__AHL92116

SEQ ID NO: 91021 - RNA, 1401 nt, Artificial Sequence; identical to SEQ ID NO: 91016
  derived and/or modified sequence opt1 from neuraminidase__InfluenzaB__AHL92127

SEQ ID NO: 91022 - RNA, 1401 nt, Artificial Sequence; identical to SEQ ID NO: 91016
  derived and/or modified sequence opt1 from neuraminidase__InfluenzaB__AHL92138

SEQ ID NO: 91023 - RNA, 1401 nt, Artificial Sequence; identical to SEQ ID NO: 91016
  derived and/or modified sequence opt1 from neuraminidase__InfluenzaB__AHL92149

SEQ ID NO: 91024 - RNA, 1401 nt, Artificial Sequence
  derived and/or modified sequence opt1 from neuraminidase__InfluenzaB__AHL92171
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcuggugagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaagaucaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcugaugugcaccgacaccuaccucgacaccccgcgccccgacgacgggagcaucacgggccccugcgaguccaacggcgacaaggggagcggcgggaucaagggcggguucguccaccagcggauggccuccaagaucggccgcugguacagccggaccauguccaagaccgagcgcaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcgcucuga

SEQ ID NO: 91025 - RNA, 1401 nt, Artificial Sequence
  derived and/or modified sequence opt1 from neuraminidase__InfluenzaB__AHL92182
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggagugggccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacagcggcacccgcggggaccggaacaagcugcgccaccucaucuccgugaagcugggcaagaucccgaccguggagaacagcaucuuccacauggccgccugguccgggagcgccugccacgacggcaaggaguggacguacaucggcgucgacgggcccgacaacaacgcgcugcucaagaucaaguacggcgaggccuacaccgacaccuaccacuccuacgccaacaacauccugcggacccaggagagcgccugcaacugcaucgggggcaacugcuaccugaugaucacggacggcagcgccuccggggugagcgagugccgcuuccucaagauccgggagggccgcaucaucaaggagaucuuccccaccgggcgggugaagcacaccgaggagugcacgugcggcuucgcguccaacaagaccaucgagugcgccugccgcgacaacagcuacaccgccaagcggcccuucgucaagcugaacguggagaccgacaccgccgagauccgccugaugugcacggacaccuaccucgacaccccgcggcccgacgacggguccaucaccggccccugcgagagcaacggcgacaagggguccggcgggaucaagggcggguucgugcaccagcgcauggccagcaagaucggccggugguacucccgcacgaugagcaagaccgagcggaugggcauggggcuguacgucaaguacgacggcgaccccugggcggacuccgacgcccuggccuucagcggggugaugguguccaugaaggagccgggcugguacagcuucggguucgagaucaaggacaagaagugcgacguccccugcaucggcaucgagauggugcacgacggcgggaaggagaccuggcacuccgccgccaccgcgaucuacugccucaugggcagcgggcagcugcugugggacacggugaccggcgucgacauggcccucuga

SEQ ID NO: 91026 - RNA, 1401 nt, Artificial Sequence; identical to SEQ ID NO: 91025
  derived and/or modified sequence opt1 from neuraminidase__InfluenzaB__AHL92193

SEQ ID NO: 91027 - RNA, 1401 nt, Artificial Sequence; identical to SEQ ID NO: 89796
  derived and/or modified sequence opt1 from neuraminidase__InfluenzaB__AHL92204

SEQ ID NO: 91028 - RNA, 1401 nt, Artificial Sequence
  derived and/or modified sequence opt1 from neuraminidase__InfluenzaB__AHL92215
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaaggggcgcgugaagcacaccgaggagugcacgugcggcuucgccagcaacaagaccaucgagugcgcgugccgggacaacuccuacaccgccaagcgccccuucgucaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucgugcaccagcggauggccuccaagaucggccgcugguacagccggacgauguccaagaccgagcgcaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 91029 - RNA, 1401 nt, Artificial Sequence; identical to SEQ ID NO: 91016
  derived and/or modified sequence opt1 from neuraminidase__InfluenzaB__AHL92226

SEQ ID NO: 91030 - RNA, 1401 nt, Artificial Sequence; identical to SEQ ID NO: 89796
  derived and/or modified sequence opt1 from neuraminidase__InfluenzaB__AHL92237

SEQ ID NO: 91031 - RNA, 1401 nt, Artificial Sequence; identical to SEQ ID NO: 91016
  derived and/or modified sequence opt1 from neuraminidase__InfluenzaB__AHL92248

SEQ ID NO: 91032 - RNA, 1401 nt, Artificial Sequence
  derived and/or modified sequence opt1 from neuraminidase__InfluenzaB__AHL92259
augcugcccagcaccauccagacccucacgcuguuccugaccuccggcggggugcuccugagccuguacgucuccgccagccucuccuaccugcuguacagcgacauccuccugaaguucuccccgaccgagaucaccgccagcacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacgacgcccugcucaagaucaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggugaagcacaccgaggagugcacgugcggcuucgccuccaacaagaccaucgagugcgcgugccgcgacaacagcuacaccgccaagcggcccuucgucaagcugaacguggagaccgacacggccgagauccgccugaugugcaccgacaccuaccucgacacgccccggccggacgacggguccaucaccggccccugcgagagcaacggcgacaagggguccggcgggaucaagggcggguucgugcaccagcgcaugaccagcaagaucggccggugguacucccgcaccaugagcaagaccgagcggaugggcauggggcuguacgucaaguacgacggcgaccccugggccgacuccgacgcccuggcguucagcggggugaugguguccaugaaggagcccggcugguacagcuucggguucgagaucaaggacaagaagugcgacgucccgugcaucggcaucgagauggugcacgacggcgggaaggagacguggcacuccgccgccaccgccaucuacugccucaugggcagcgggcagcugcugugggacaccgugaccggcgucgacauggcccucuga

SEQ ID NO: 91033 - RNA, 1401 nt, Artificial Sequence; identical to SEQ ID NO: 91016
  derived and/or modified sequence opt1 from neuraminidase__InfluenzaB__AHL92270

SEQ ID NO: 91034 - RNA, 1401 nt, Artificial Sequence
  derived and/or modified sequence opt1 from neuraminidase__InfluenzaB__AHL92281
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgccaaccacuccgccaccaagggcgugacccuccugcugcccgagccggaguggaccuacccccgccucagcugccccggguccacguuccagaaggcgcugcugaucagcccccaccgguucggcgagaccaaggggaacuccgccccgcucaucauccgcgagcccuucaucgccugcggccccaacgagugcaagcacuucgcccugacccacuacgcggcccagcccggcggguacuacaacggcacccgcggggaccggaacaagcugcggcaccucaucagcgucaagcugggcaagaucccgacgguggagaacuccaucuuccacauggccgccuggagcggguccgccugccacgacggcaaggaguggaccuacaucggcguggacgggcccgacaacaacgcgcugcucaagaucaaguacggcgaggccuacaccgacaccuaccacagcuacgccaacaagauccugcgcacgcaggaguccgccugcaacugcaucgggggcaacugcuaccugaugaucaccgacggcagcgccagcggggucuccgagugccgguuccucaagauccgcgagggccggaucaucaaggagaucuuccccaccgggcgcgugaagcacaccgaggagugcacgugcggcuucgcgagcaacaagaccaucgagugcgccugccgggacaacuccuacaccgccaagcgccccuucgugaagcugaacgucgagaccgacacggccgagauccggcugaugugcaccgacaccuaccucgacaccccgcgccccgacgacgggagcaucacgggccccugcgaguccaacggcgacaaggggagcggcgggaucaagggcggguucgugcaccagcggauggccuccaagaucggccgcugguacagccggaccauguccaagaccgagcgcaugggcauggggcuguacgugaaguacgacggcgaccccugggcggacagcgacgcccuggccuucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggcgaucuacugccucaugggcuccgggcagcugcugugggacaccgugaccggcguggacauggcccucuga

SEQ ID NO: 91035 - RNA, 1401 nt, Artificial Sequence
  derived and/or modified sequence opt1 from neuraminidase__InfluenzaB__AHL92303
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaagaucaaguacggcgaggcguacaccgacaccuaccacagcuacgccaacaacauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacacggccgagauccgccugaugugcaccgacaccuaccuggacaccccgcggcccgacgacgggagcaucacgggccccugcgaguccaacggcaacaaggggagcggcgggaucaagggcggguucgugcaccagcgcauggccuccaagaucggccggugguacagccgcaccauguccaagaccgagcggaugggcauggggcucuacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccugaugggcuccgggcagcuccugugggacaccgugaccggcgucgacauggcgcuguga

SEQ ID NO: 91036 - RNA, 1401 nt, Artificial Sequence
  derived and/or modified sequence opt1 from neuraminidase__InfluenzaB__AHL92314
augcugcccagcaccauccagacccucacgcuguuccugaccuccggcggggugcuccugagccuguacgucuccgccagccucuccuaccugcuguacagcgacauccuccugaaguucucccagaccaagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacgucggcguggacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggacgagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacauggcgcuguga

SEQ ID NO: 91037 - RNA, 1401 nt, Artificial Sequence
  derived and/or modified sequence opt1 from neuraminidase__InfluenzaB__AHL92325
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucauggugagcaugggggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcguggacauggcgcuguga

SEQ ID NO: 91038 - RNA, 1401 nt, Artificial Sequence; identical to SEQ ID NO: 89796
  derived and/or modified sequence opt1 from neuraminidase__InfluenzaB__AHL92336

SEQ ID NO: 91039 - RNA, 1401 nt, Artificial Sequence
  derived and/or modified sequence opt1 from neuraminidase__InfluenzaB__AHL92358
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccaaggagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacgucggcguggacggcccggacagcaacgcgcugcucaagaucaaguacggggaggccuacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcaccgagacguaccucgacaccccgcggcccaacgacggcagcaucaccgggcccugcgaguccgacggcgacaagggcagcgggggcaucaagggcggguucgugcaccagcgcauggccuccaagaucgggcggugguacagccgcaccauguccaagacgaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccaccuggcacagcgccgccacggccaucuacugccugaugggguccggccagcugcucugggacaccgugaccggggucgacauggcgcuguga

SEQ ID NO: 91040 - RNA, 1401 nt, Artificial Sequence; identical to SEQ ID NO: 91039
  derived and/or modified sequence opt1 from neuraminidase__InfluenzaB__AHL92369

SEQ ID NO: 91041 - RNA, 1401 nt, Artificial Sequence
  derived and/or modified sequence opt1 from neuraminidase__InfluenzaB__AHL92380
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucaagcuccugcugcccgagcccgaguggaccuacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacgcacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggaccuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccggggugaacaugacccuguga

SEQ ID NO: 91042 - RNA, 1401 nt, Artificial Sequence
  derived and/or modified sequence opt1 from neuraminidase__InfluenzaB__AHL92391
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcagcaagcugcggcaccucaucuccgugaagcuggggaagauccccaccguggagaacagcaucuuccacauggccgccugguccggcagcgccugccacgacgggcgcgaguggacguacaucggcgucgacggcccggacuccaacgcccugcucaagaucaaguacggggaggcguacaccgacaccuaccacagcuacgccaagaacauccugcggacccaggagagcgccugcaacugcaucggcggggacugcuaccugaugaucacggacggccccgccuccggcaucagcgagugccgcuuccucaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccugaugugcacggagaccuaccucgacaccccgcggcccaacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcccuggcgcucagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcugcucugggacaccgugaccggggugaacaugacgcuguga

SEQ ID NO: 91043 - RNA, 1401 nt, Artificial Sequence; identical to SEQ ID NO: 89825
  derived and/or modified sequence opt1 from neuraminidase__InfluenzaB__AHL92402

SEQ ID NO: 91044 - RNA, 1401 nt, Artificial Sequence; identical to SEQ ID NO: 89825
  derived and/or modified sequence opt1 from neuraminidase__InfluenzaB__AHL92413

SEQ ID NO: 91045 - RNA, 1401 nt, Artificial Sequence; identical to SEQ ID NO: 89825
  derived and/or modified sequence opt1 from neuraminidase__InfluenzaB__AHL92424

SEQ ID NO: 91046 - RNA, 1401 nt, Artificial Sequence
  derived and/or modified sequence opt1 from neuraminidase__InfluenzaB__AHL92435
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcgcuggcccucuccggcgucaugaucagcauggaggagccggggugguacuccuucggcuucgagaucaaggacaagaagugcgacgugcccugcaucgggaucgagauggugcacgacggcggcaagaccacguggcacagcgccgccaccgccaucuacugccugaugggguccggccagcugcucugggacaccgucaccgggguggacauggcgcuguga

SEQ ID NO: 91047 - RNA, 1401 nt, Artificial Sequence; identical to SEQ ID NO: 89825
  derived and/or modified sequence opt1 from neuraminidase__InfluenzaB__AHL92446

SEQ ID NO: 91048 - RNA, 1401 nt, Artificial Sequence; identical to SEQ ID NO: 89825
  derived and/or modified sequence opt1 from neuraminidase__InfluenzaB__AHL92457

SEQ ID NO: 91049 - RNA, 1401 nt, Artificial Sequence; identical to SEQ ID NO: 89825
  derived and/or modified sequence opt1 from neuraminidase__InfluenzaB__AHL92468

SEQ ID NO: 91050 - RNA, 1401 nt, Artificial Sequence; identical to SEQ ID NO: 89825
  derived and/or modified sequence opt1 from neuraminidase__InfluenzaB__AHL92479

SEQ ID NO: 91051 - RNA, 1401 nt, Artificial Sequence; identical to SEQ ID NO: 89796
  derived and/or modified sequence opt1 from neuraminidase__InfluenzaB__AHL92490

SEQ ID NO: 91052 - RNA, 1401 nt, Artificial Sequence; identical to SEQ ID NO: 89825
  derived and/or modified sequence opt1 from neuraminidase__InfluenzaB__AHL92501

SEQ ID NO: 91053 - RNA, 1401 nt, Artificial Sequence
  derived and/or modified sequence opt1 from neuraminidase__InfluenzaB__AHL92512
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggucgccuggagcggcuccgccugccacgacgggcgcgaguggacguacaucggcguggacggcccggacagcaacgcccugcucaagaucaaguacggggaggccuacaccgacaccuaccacuccuacgcgaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggcccuucgucaagcugaacguggagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcccuggcccucuccggcgugauggugagcauggaggagccggggugguacuccuucggcuucgagaucaaggacaagaagugcgacguccccugcaucgggaucgagauggugcacgacggcggcaagaccacguggcacagcgcggccaccgccaucuacugccugaugggguccggccagcugcucugggacaccgugaccggggucaacaugacgcuguga

SEQ ID NO: 91054 - RNA, 1401 nt, Artificial Sequence; identical to SEQ ID NO: 89825
  derived and/or modified sequence opt1 from neuraminidase__InfluenzaB__AHL92523

SEQ ID NO: 91055 - RNA, 1401 nt, Artificial Sequence; identical to SEQ ID NO: 89825
  derived and/or modified sequence opt1 from neuraminidase__InfluenzaB__AHL92534

SEQ ID NO: 91056 - RNA, 1401 nt, Artificial Sequence; identical to SEQ ID NO: 89796
  derived and/or modified sequence opt1 from neuraminidase__InfluenzaB__AHL92545

SEQ ID NO: 91057 - RNA, 1401 nt, Artificial Sequence; identical to SEQ ID NO: 89825
  derived and/or modified sequence opt1 from neuraminidase__InfluenzaB__AHL92556

SEQ ID NO: 91058 - RNA, 1401 nt, Artificial Sequence; identical to SEQ ID NO: 89825
  derived and/or modified sequence opt1 from neuraminidase__InfluenzaB__AHL92567

SEQ ID NO: 91059 - RNA, 1401 nt, Artificial Sequence; identical to SEQ ID NO: 89825
  derived and/or modified sequence opt1 from neuraminidase__InfluenzaB__AHL92578

SEQ ID NO: 91060 - RNA, 1401 nt, Artificial Sequence; identical to SEQ ID NO: 89796
  derived and/or modified sequence opt1 from neuraminidase__InfluenzaB__AHL92589

SEQ ID NO: 91061 - RNA, 1401 nt, Artificial Sequence; identical to SEQ ID NO: 89825
  derived and/or modified sequence opt1 from neuraminidase__InfluenzaB__AHL92600

SEQ ID NO: 91062 - RNA, 1401 nt, Artificial Sequence; identical to SEQ ID NO: 90852
  derived and/or modified sequence opt1 from neuraminidase__InfluenzaB__AHL92611

SEQ ID NO: 91063 - RNA, 1401 nt, Artificial Sequence
  derived and/or modified sequence opt1 from neuraminidase__InfluenzaB__AHL92622
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucaccuuccuccugcccgagcccgaguggaccuacccgcgccugagcugccccggguccaccuuccagaaggcccuccugaucagcccccaccgguucggcgagacgaaggggaacuccgcgccccugaucauccgcgagccguucaucgccugcggccccaaggagugcaagcacuucgcccucacccacuacgccgcgcagcccggcggguacuacaacggcacccgggaggaccgcaacaagcugcggcaccugaucagcgugaagcucgggaagauccccaccguggagaacuccaucuuccacauggccgccuggagcggcuccgccugccacgacgggcgcgaguggacguacaucggcgucgacggcccggacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcucaacgucgagaccgacaccgccgagauccgccugaugugcacggagaccuaccuggacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccucuacgugaaguacgacggggaccccuggaccgacagcgaggcccuggcgcuguccggcgucauggugagcauggaggagccggggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccggggugaacaugacgcucuga

SEQ ID NO: 91064 - RNA, 1401 nt, Artificial Sequence
  derived and/or modified sequence opt1 from neuraminidase__InfluenzaB__AHL92633
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucaccuuccuccugcccgagcccgaguggaccuacccgcgccugagcugccccggguccaccuuccagaaggcccuccugaucagcccccaccgguucggcgagacgaaggggaacuccgcgccccugaucauccgcgagccguucaucgccugcggccccaaggagugcaagcacuucgcccucacccacuacgccgcgcagcccggcggguacuacaacggcacccgggaggaccgcaacaagcugcggcaccugaucagcgugaagcucgggaagauccccaucguggagaacuccaucuuccacauggccgccuggagcggcuccgccugccacgacgggcgcgaguggaccuacaucggcgucgacggcccggacagcaacgcccugcugaagaucaaguacggggaggcguacacggacaccuaccacuccuacgccaagaacauccuccggacccaggagagcgccugcaacugcaucggcggggacugcuaccugaugaucaccgacggccccgccagcggcaucuccgagugccgcuuccugaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcucaacgucgagaccgacaccgccgagauccgccugaugugcaccgagacguaccuggacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccucuacgugaaguacgacggggaccccuggaccgacagcgaggcccuggcgcuguccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccucaugggguccggccagcugcugugggacaccgugaccggggugaacaugacccucuga

SEQ ID NO: 91065 - RNA, 1401 nt, Artificial Sequence; identical to SEQ ID NO: 89796
  derived and/or modified sequence opt1 from neuraminidase__InfluenzaB__AHL92644

SEQ ID NO: 91066 - RNA, 1401 nt, Artificial Sequence; identical to SEQ ID NO: 89796
  derived and/or modified sequence opt1 from neuraminidase__InfluenzaB__AHL92655

SEQ ID NO: 91067 - RNA, 1401 nt, Artificial Sequence; identical to SEQ ID NO: 89825
  derived and/or modified sequence opt1 from neuraminidase__InfluenzaB__AHL92666

SEQ ID NO: 91068 - RNA, 1401 nt, Artificial Sequence; identical to SEQ ID NO: 89825
  derived and/or modified sequence opt1 from neuraminidase__InfluenzaB__AHL92677

SEQ ID NO: 91069 - RNA, 1401 nt, Artificial Sequence; identical to SEQ ID NO: 89796
  derived and/or modified sequence opt1 from neuraminidase__InfluenzaB__AHL92688

SEQ ID NO: 91070 - RNA, 1401 nt, Artificial Sequence; identical to SEQ ID NO: 89825
  derived and/or modified sequence opt1 from neuraminidase__InfluenzaB__AHL92699

SEQ ID NO: 91071 - RNA, 1401 nt, Artificial Sequence; identical to SEQ ID NO: 89825
  derived and/or modified sequence opt1 from neuraminidase__InfluenzaB__AHL92710

SEQ ID NO: 91072 - RNA, 1401 nt, Artificial Sequence; identical to SEQ ID NO: 89825
  derived and/or modified sequence opt1 from neuraminidase__InfluenzaB__AHL92721

SEQ ID NO: 91073 - RNA, 1401 nt, Artificial Sequence; identical to SEQ ID NO: 89825
  derived and/or modified sequence opt1 from neuraminidase__InfluenzaB__AHL92732

SEQ ID NO: 91074 - RNA, 1401 nt, Artificial Sequence; identical to SEQ ID NO: 89825
  derived and/or modified sequence opt1 from neuraminidase__InfluenzaB__AHL92743

SEQ ID NO: 91075 - RNA, 1401 nt, Artificial Sequence; identical to SEQ ID NO: 89825
  derived and/or modified sequence opt1 from neuraminidase__InfluenzaB__AHL92754

SEQ ID NO: 91076 - RNA, 1401 nt, Artificial Sequence; identical to SEQ ID NO: 89825
  derived and/or modified sequence opt1 from neuraminidase__InfluenzaB__AHL92765

SEQ ID NO: 91077 - RNA, 1401 nt, Artificial Sequence; identical to SEQ ID NO: 89825
  derived and/or modified sequence opt1 from neuraminidase__InfluenzaB__AHL92776

SEQ ID NO: 91078 - RNA, 1401 nt, Artificial Sequence; identical to SEQ ID NO: 89825
  derived and/or modified sequence opt1 from neuraminidase__InfluenzaB__AHL92787

SEQ ID NO: 91079 - RNA, 1401 nt, Artificial Sequence; identical to SEQ ID NO: 89825
  derived and/or modified sequence opt1 from neuraminidase__InfluenzaB__AHL92798

SEQ ID NO: 91080 - RNA, 1401 nt, Artificial Sequence
  derived and/or modified sequence opt1 from neuraminidase__InfluenzaB__AHL92809
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccaucaagggcgucacgcuccugcugcccgagcccgaguggaccuacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacgcacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggaccuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcaucuccgagugccgcuuccucaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcaccgagacguaccucgacaccccgcggcccaacgacggcagcaucaccgggcccugcgaguccaacggcgacaagggcagcgggggcaucaagggcggguucgugcaccagcgcauggccuccaagaucgggcggugguacagccgcaccauguccaagacgaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccugaugggguccggccagcugcucugggacaccgugaccggggugaacaugacccuguga

SEQ ID NO: 91081 - RNA, 1401 nt, Artificial Sequence
  derived and/or modified sequence opt1 from neuraminidase__InfluenzaB__AHL92820
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacccuccugcugcccgagcccgaguggaccuacccgcgccucagcugccccggguccaccuuccagaaggcccugcugaucagcccccaccgguucggcgagacgaaggggaacuccgcgccccucaucauccgcgagccguucaucgccugcggccccaaggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggcgcgaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccuguacgugaaguacgacggggaccccuggaccgacagcgaggcccuggcgcucuccggcgucauggugagcauggaggagccggggugguacuccuucggcuucgagaucaaggacaagaagugcgacgugcccugcaucgggaucgagaugguccacgacggcggcaagaagaccuggcacagcgccgccacggccaucuacugccugaugggguccggccagcugcucugggacaccgugaccggggugaacaugacccuguga

SEQ ID NO: 91082 - RNA, 1401 nt, Artificial Sequence
  derived and/or modified sequence opt1 from neuraminidase__InfluenzaB__AHL92842
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccacgaccaagggcgucacccuccugcugcccgagcccgaguggaccuacccgcgccucagcugccccggguccacguuccagaaggcccugcugaucagcccccaccgguucggcgagaccaaggggaacuccgcgccccucaucauccgcgagccguucaucgccugcggccccaaggagugcaagcacuucgcccugacccacuacgccgcccagcccggcggguacuacaacggcacccgggaggaccgcaacaagcugcggcaccucaucagcgugaagcuggggaagauccccacgguggagaacuccaucuuccacauggcggccuggagcggcuccgccugccacgacgggcgcgaguggaccuacaucggcgucgacggcccggacagcaacgcccugcucaagaucaaguacggggaggccuacaccgacaccuaccacuccuacgcgaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggcccuucgugaagcugaacgucgagaccgacacggccgagauccgccugaugugcaccgagaccuaccucgacaccccgcggcccaacgacggcagcaucacggggcccugcgaguccaacggcgacaagggcagcgggggcaucaagggcggguucgugcaccagcgcauggccuccaagaucgggcggugguacagccgcaccauguccaagaccaagcggaugggcaugggccuguacgugaaguacgacggggaccccuggaccgacagcgaggcccuggcccucuccggcgucauggugagcauggaggagccggggugguacuccuucggcuucgagaucaaggacaagaagugcgacgugcccugcaucgggaucgagaugguccacgacggcggcaagacgaccuggcacagcgcggccaccgccaucuacugccugaugggguccggccagcugcucugggacaccgugacgggggugaacaugacccuguga

SEQ ID NO: 91083 - RNA, 1401 nt, Artificial Sequence; identical to SEQ ID NO: 89825
  derived and/or modified sequence opt1 from neuraminidase__InfluenzaB__AHL92853

SEQ ID NO: 91084 - RNA, 1401 nt, Artificial Sequence; identical to SEQ ID NO: 89825
  derived and/or modified sequence opt1 from neuraminidase__InfluenzaB__AHL92864

SEQ ID NO: 91085 - RNA, 1401 nt, Artificial Sequence; identical to SEQ ID NO: 89678
  derived and/or modified sequence opt1 from neuraminidase__InfluenzaB__AHL92875

SEQ ID NO: 91086 - RNA, 1401 nt, Artificial Sequence; identical to SEQ ID NO: 89635
  derived and/or modified sequence opt1 from neuraminidase__InfluenzaB__AHL92886

SEQ ID NO: 91087 - RNA, 1401 nt, Artificial Sequence
  derived and/or modified sequence opt1 from neuraminidase__InfluenzaB__AHL92897
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaucccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 91088 - RNA, 1401 nt, Artificial Sequence
  derived and/or modified sequence opt1 from neuraminidase__InfluenzaB__AHL92908
augcugcccagcaccauccagacccucacgcuguuccugacccucggcggggugcugcugucccucuacgucagcgccucccugagcuaccugcucuacuccgacauccugcugaaguucagccagaccgagaucaccgccccgaucaugccccucgacugcgcgaacgccuccaacgugcaggccgugaaccgcagcgccacgaagggcgucacccugcugcuccccgagcccgaguggaccuacccgcggcuguccugccccgggagcaccuuccagaaggcccugcucaucagcccccaccgcuucggcgagacgaaggggaacuccgcgccccugaucauccgggagccguucaucgccugcggccccaaggagugcaagcacuucgcccugacccacuacgccgcgcagcccggcggguacuacaacggcacccgcgaggaccggaacaagcuccgccaccugaucuccgugaagcuggggaagauccccaccguggagaacagcaucuuccacauggccgccugguccggcagcgccugccacgacgggaaggaguggacguacaucggcgucgacggcccggacuccaacgcccuccugaagaucaaguacggggaggcguacaccgacaccuaccacagcuacgccaagaacauccugcggacccaggaguccgccugcaacugcaucggcggggacugcuaccucaugaucacggacggccccgccagcggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccucaugugcacggagaccuaccuggacaccccgcggcccaacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcccucgcgcugagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccguguacugccugauggggagcggccagcuccugugggacaccaucaccgggguggacauggcccuguga

SEQ ID NO: 91089 - RNA, 1401 nt, Artificial Sequence
  derived and/or modified sequence opt1 from neuraminidase__InfluenzaB__AHL92919
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcaucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgugaaguacgacggcgaccccugggccgacagcgacgcgcuggccuucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcgcucuga

SEQ ID NO: 91090 - RNA, 1401 nt, Artificial Sequence
  derived and/or modified sequence opt1 from neuraminidase__InfluenzaB__AHL92930
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacgacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcuggacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 91091 - RNA, 1401 nt, Artificial Sequence; identical to SEQ ID NO: 89635
  derived and/or modified sequence opt1 from neuraminidase__InfluenzaB__AHL92941

SEQ ID NO: 91092 - RNA, 1401 nt, Artificial Sequence; identical to SEQ ID NO: 89643
  derived and/or modified sequence opt1 from neuraminidase__InfluenzaB__AHL92952

SEQ ID NO: 91093 - RNA, 1401 nt, Artificial Sequence; identical to SEQ ID NO: 89643
  derived and/or modified sequence opt1 from neuraminidase__InfluenzaB__AHL92963

SEQ ID NO: 91094 - RNA, 1401 nt, Artificial Sequence
  derived and/or modified sequence opt1 from neuraminidase__InfluenzaB__AHL92974
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcacgccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggccuccaagaucggccggugguacagccgcaccauguccaagaccgagcggaugggcauggggcuguacgucaaguacaacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcgcucuga

SEQ ID NO: 91095 - RNA, 1401 nt, Artificial Sequence; identical to SEQ ID NO: 89643
  derived and/or modified sequence opt1 from neuraminidase__InfluenzaB__AHL92985

SEQ ID NO: 91096 - RNA, 1401 nt, Artificial Sequence; identical to SEQ ID NO: 89643
  derived and/or modified sequence opt1 from neuraminidase__InfluenzaB__AHL92996

SEQ ID NO: 91097 - RNA, 1401 nt, Artificial Sequence; identical to SEQ ID NO: 91016
  derived and/or modified sequence opt1 from neuraminidase__InfluenzaB__AHL93008

SEQ ID NO: 91098 - RNA, 1401 nt, Artificial Sequence; identical to SEQ ID NO: 91025
  derived and/or modified sequence opt1 from neuraminidase__InfluenzaB__AHL93019

SEQ ID NO: 91099 - RNA, 1401 nt, Artificial Sequence; identical to SEQ ID NO: 91025
  derived and/or modified sequence opt1 from neuraminidase__InfluenzaB__AHL93030

SEQ ID NO: 91100 - RNA, 1401 nt, Artificial Sequence; identical to SEQ ID NO: 91039
  derived and/or modified sequence opt1 from neuraminidase__InfluenzaB__AHL93041

SEQ ID NO: 91101 - RNA, 1401 nt, Artificial Sequence; identical to SEQ ID NO: 91039
  derived and/or modified sequence opt1 from neuraminidase__InfluenzaB__AHL93052

SEQ ID NO: 91102 - RNA, 1401 nt, Artificial Sequence; identical to SEQ ID NO: 89825
  derived and/or modified sequence opt1 from neuraminidase__InfluenzaB__AHL93063

SEQ ID NO: 91103 - RNA, 1401 nt, Artificial Sequence; identical to SEQ ID NO: 89825
  derived and/or modified sequence opt1 from neuraminidase__InfluenzaB__AHL93074

SEQ ID NO: 91104 - RNA, 1401 nt, Artificial Sequence; identical to SEQ ID NO: 89825
  derived and/or modified sequence opt1 from neuraminidase__InfluenzaB__AHL93085

SEQ ID NO: 91105 - RNA, 1401 nt, Artificial Sequence; identical to SEQ ID NO: 91082
  derived and/or modified sequence opt1 from neuraminidase__InfluenzaB__AHL93096

SEQ ID NO: 91106 - RNA, 1401 nt, Artificial Sequence; identical to SEQ ID NO: 89825
  derived and/or modified sequence opt1 from neuraminidase__InfluenzaB__AHL93107

SEQ ID NO: 91107 - RNA, 1401 nt, Artificial Sequence; identical to SEQ ID NO: 89825
  derived and/or modified sequence opt1 from neuraminidase__InfluenzaB__AHL93118

SEQ ID NO: 91108 - RNA, 1401 nt, Artificial Sequence; identical to SEQ ID NO: 89796
  derived and/or modified sequence opt1 from neuraminidase__InfluenzaB__AHL93129

SEQ ID NO: 91109 - RNA, 1401 nt, Artificial Sequence; identical to SEQ ID NO: 89825
  derived and/or modified sequence opt1 from neuraminidase__InfluenzaB__AHL93140

SEQ ID NO: 91110 - RNA, 1401 nt, Artificial Sequence; identical to SEQ ID NO: 89796
  derived and/or modified sequence opt1 from neuraminidase__InfluenzaB__AHL93151

SEQ ID NO: 91111 - RNA, 1401 nt, Artificial Sequence; identical to SEQ ID NO: 89825
  derived and/or modified sequence opt1 from neuraminidase__InfluenzaB__AHL93162

SEQ ID NO: 91112 - RNA, 1401 nt, Artificial Sequence; identical to SEQ ID NO: 89825
  derived and/or modified sequence opt1 from neuraminidase__InfluenzaB__AHL93173

SEQ ID NO: 91113 - RNA, 1401 nt, Artificial Sequence; identical to SEQ ID NO: 89796
  derived and/or modified sequence opt1 from neuraminidase__InfluenzaB__AHL93184

SEQ ID NO: 91114 - RNA, 1401 nt, Artificial Sequence; identical to SEQ ID NO: 89825
  derived and/or modified sequence opt1 from neuraminidase__InfluenzaB__AHL93195

SEQ ID NO: 91115 - RNA, 1401 nt, Artificial Sequence; identical to SEQ ID NO: 89825
  derived and/or modified sequence opt1 from neuraminidase__InfluenzaB__AHL93206

SEQ ID NO: 91116 - RNA, 1401 nt, Artificial Sequence; identical to SEQ ID NO: 89969
  derived and/or modified sequence opt1 from neuraminidase__InfluenzaB__AHL93217

SEQ ID NO: 91117 - RNA, 1401 nt, Artificial Sequence; identical to SEQ ID NO: 89969
  derived and/or modified sequence opt1 from neuraminidase__InfluenzaB__AHL93228

SEQ ID NO: 91118 - RNA, 1401 nt, Artificial Sequence
  derived and/or modified sequence opt1 from neuraminidase__InfluenzaB__AHL93239
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacacggccgagauccgccugaugugcaccgacaccuaccuggacaccccgcggcccgacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcucuacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcuccugugggacaccgucaccggcguggacauggcccuguga

SEQ ID NO: 91119 - RNA, 1401 nt, Artificial Sequence
  derived and/or modified sequence opt1 from neuraminidase__InfluenzaB__AHL93250
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91120 - RNA, 1401 nt, Artificial Sequence; identical to SEQ ID NO: 89969
  derived and/or modified sequence opt1 from neuraminidase__InfluenzaB__AHL93261

SEQ ID NO: 91121 - RNA, 1401 nt, Artificial Sequence; identical to SEQ ID NO: 89969
  derived and/or modified sequence opt1 from neuraminidase__InfluenzaB__AHL93272

SEQ ID NO: 91122 - RNA, 1401 nt, Artificial Sequence; identical to SEQ ID NO: 89969
  derived and/or modified sequence opt1 from neuraminidase__InfluenzaB__AHL93283

SEQ ID NO: 91123 - RNA, 1401 nt, Artificial Sequence; identical to SEQ ID NO: 89969
  derived and/or modified sequence opt1 from neuraminidase__InfluenzaB__AHL93294

SEQ ID NO: 91124 - RNA, 1401 nt, Artificial Sequence
  derived and/or modified sequence opt1 from neuraminidase__InfluenzaB__AHL93305
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucguggccugcggccccaacgagugcaagcacuucgcccugacccacuacgccgcgcagcccggcggguacuacaacggcacccgcggggaccggaacaagcugcgccaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccaacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggcguucuccggggucauggugagcaugaaggagccgggcugguacuccuucggguucgagaucaaggacaagaagugcgacgugcccugcaucggcaucgagaugguccacgacggcgggaaggagaccuggcacagcgccgccacggccaucuacugccucaugggcuccgggcagcugcugugggacaccgugaccggcguggacauggcccucuga

SEQ ID NO: 91125 - RNA, 1401 nt, Artificial Sequence; identical to SEQ ID NO: 89969
  derived and/or modified sequence opt1 from neuraminidase__InfluenzaB__AHL93316

SEQ ID NO: 91126 - RNA, 1401 nt, Artificial Sequence
  derived and/or modified sequence opt1 from neuraminidase__InfluenzaB__AHL93338
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacgccgccgagauccgccugaugugcacggacaccuaccucgacaccccgcggcccaacgacgggagcaucaccggccccugcgaguccaacggcgacaaggggagcggcgggaucaagggcggguucguccaccagcgcauggaguccaagaucggccggugguacagccgcacgauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcgcucuga

SEQ ID NO: 91127 - RNA, 1401 nt, Artificial Sequence
  derived and/or modified sequence opt1 from neuraminidase__InfluenzaB__AHL93349
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccagggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacacgccccggccgaacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggagcuguacgugaaguacgacggggaccccugggccgacagcgacgcccuggcguucuccggcgugauggucagcaugaaggagcccgggugguacuccuucggcuucgagaucaaggacaagaagugcgacgugccgugcaucgggaucgagauggugcacgacggcggcaaggagaccuggcacagcgccgccacggccaucuacugccucaugggguccggccagcugcugugggacaccgucaccggggugaacauggcccucuga

SEQ ID NO: 91128 - RNA, 1401 nt, Artificial Sequence; identical to SEQ ID NO: 89969
  derived and/or modified sequence opt1 from neuraminidase__InfluenzaB__AHL93371

SEQ ID NO: 91129 - RNA, 1401 nt, Artificial Sequence
  derived and/or modified sequence opt1 from neuraminidase__InfluenzaB__AHL93382
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggagcuguacgugaaguacgacggggaccccugggccgacagcgacgcccuggcguucuccggcgugauggucagcaugaaggagccggggugguacuccuucggcuucgagaucaaggacaagaagugcgacgugcccugcaucgggaucgagauggugcacgacggcggcaaggagaccuggcacagcgccgccacggccaucuacugccucaugggguccggccagcugcugugggacaccgucaccggggugaacauggcccucuga

SEQ ID NO: 91130 - RNA, 1401 nt, Artificial Sequence; identical to SEQ ID NO: 89969
  derived and/or modified sequence opt1 from neuraminidase__InfluenzaB__AHL93393

SEQ ID NO: 91131 - RNA, 1401 nt, Artificial Sequence; identical to SEQ ID NO: 89969
  derived and/or modified sequence opt1 from neuraminidase__InfluenzaB__AHL93404

SEQ ID NO: 91132 - RNA, 1401 nt, Artificial Sequence; identical to SEQ ID NO: 89969
  derived and/or modified sequence opt1 from neuraminidase__InfluenzaB__AHL93415

SEQ ID NO: 91133 - RNA, 1401 nt, Artificial Sequence; identical to SEQ ID NO: 89969
  derived and/or modified sequence opt1 from neuraminidase__InfluenzaB__AHL93426

SEQ ID NO: 91134 - RNA, 1401 nt, Artificial Sequence; identical to SEQ ID NO: 89969
  derived and/or modified sequence opt1 from neuraminidase__InfluenzaB__AHL93437

SEQ ID NO: 91135 - RNA, 1401 nt, Artificial Sequence; identical to SEQ ID NO: 91129
  derived and/or modified sequence opt1 from neuraminidase__InfluenzaB__AHL93448

SEQ ID NO: 91136 - RNA, 1404 nt, Artificial Sequence
  derived and/or modified sequence opt1 from neuraminidase__InfluenzaB__AHL93459
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaacgagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaaggugaaguacggcgaggcguacaccgacaccuaccacagcuacgccaacaagauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccucaugugcaccgacaccuaccuggacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccucgcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcugcucugggacaccgucaccggcguggacauggcccuguga

SEQ ID NO: 91137 - RNA, 1401 nt, Artificial Sequence
  derived and/or modified sequence opt1 from neuraminidase__InfluenzaB__AHL93470
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccugaccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 91138 - RNA, 1401 nt, Artificial Sequence; identical to SEQ ID NO: 89906
  derived and/or modified sequence opt1 from neuraminidase__InfluenzaB__AHL93481

SEQ ID NO: 91139 - RNA, 1401 nt, Artificial Sequence; identical to SEQ ID NO: 89964
  derived and/or modified sequence opt1 from neuraminidase__InfluenzaB__AHL93492

SEQ ID NO: 91140 - RNA, 1401 nt, Artificial Sequence; identical to SEQ ID NO: 89825
  derived and/or modified sequence opt1 from neuraminidase__InfluenzaB__AHL93503

SEQ ID NO: 91141 - RNA, 1401 nt, Artificial Sequence
  derived and/or modified sequence opt1 from neuraminidase__InfluenzaB__AHL93514
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcaucaagcugggcaagaucccgacgguggagaacuccaucuuccacauggccgccuggagcggguccgccugccacgacggcaaggaguggaccuacaucggcguggacgggcccgacaacaacgcccugcucaaggucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccgacgacgggagcaucacgggcuccugcgagagcaacggcgacaagggguccggcgggaucaagggcggguucgugcaccagcgcauggagagcaagaucggccggugguacucccgcaccaugagcaagaccgagcggaugggcauggggcuguacgucaaguacgacggcgaccccugggccgacuccgacgcccugaccuucagcggggugaugguguccaugaaggagcccggcugguacagcuucggguucgagaucaaggacaagaagugcgacgucccgugcaucggcaucgagauggugcacgacggcgggaaggagacguggcacuccgcggccaccgccaucuacugccucaugggcagcgggcagcugcugugggacaccgugaccggcgucgacauggcccucuga

SEQ ID NO: 91142 - RNA, 1401 nt, Artificial Sequence; identical to SEQ ID NO: 89825
  derived and/or modified sequence opt1 from neuraminidase__InfluenzaB__AHL93525

SEQ ID NO: 91143 - RNA, 1401 nt, Artificial Sequence; identical to SEQ ID NO: 89964
  derived and/or modified sequence opt1 from neuraminidase__InfluenzaB__AHL93536

SEQ ID NO: 91144 - RNA, 1401 nt, Artificial Sequence
  derived and/or modified sequence opt1 from neuraminidase__InfluenzaB__AHL93558
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucauccaccagcgcauggaguccaagaucggccggugguacagccgcacgauguccaagaccgagcggaugggcauggggcuguacgucaaguacgacggcgaccccugggccgacagcgacgcgcuggccuucuccggggugauggugagcaugaaggagccgggcugguacuccuucggguucgagaucaaggacaagaagugcgacguccccugcaucggcaucgagauggugcacgacggcgggaaggagaccuggcacagcgccgccaccgccaucuacugccucaugggcuccgggcagcugcugugggacacggugaccggcgucgacauggcgcucuga

SEQ ID NO: 91145 - RNA, 1401 nt, Artificial Sequence
  derived and/or modified sequence opt1 from neuraminidase__InfluenzaB__AHL93569
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccugaccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 91146 - RNA, 1401 nt, Artificial Sequence; identical to SEQ ID NO: 89964
  derived and/or modified sequence opt1 from neuraminidase__InfluenzaB__AHL93580

SEQ ID NO: 91147 - RNA, 1401 nt, Artificial Sequence; identical to SEQ ID NO: 89964
  derived and/or modified sequence opt1 from neuraminidase__InfluenzaB__AHL93591

SEQ ID NO: 91148 - RNA, 1401 nt, Artificial Sequence
  derived and/or modified sequence opt1 from neuraminidase__InfluenzaB__AHL93613
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggucuucuccggggugauggugagcaugaaggagccgggcugguacuccuucggguucgagaucaaggacaagaagugcgacguccccugcaucggcaucgagauggugcacgacggcgggaaggagaccuggcacagcgcggccacggccaucuacugccucaugggcuccgggcagcugcugugggacaccgugaccggcgucgacauggcccucuga

SEQ ID NO: 91149 - RNA, 1401 nt, Artificial Sequence; identical to SEQ ID NO: 89964
  derived and/or modified sequence opt1 from neuraminidase__InfluenzaB__AHL93624

SEQ ID NO: 91150 - RNA, 1401 nt, Artificial Sequence; identical to SEQ ID NO: 91148
  derived and/or modified sequence opt1 from neuraminidase__InfluenzaB__AHL93635

SEQ ID NO: 91151 - RNA, 1401 nt, Artificial Sequence; identical to SEQ ID NO: 91148
  derived and/or modified sequence opt1 from neuraminidase__InfluenzaB__AHL93646

SEQ ID NO: 91152 - RNA, 1401 nt, Artificial Sequence; identical to SEQ ID NO: 89825
  derived and/or modified sequence opt1 from neuraminidase__InfluenzaB__AHL93657

SEQ ID NO: 91153 - RNA, 1401 nt, Artificial Sequence; identical to SEQ ID NO: 89964
  derived and/or modified sequence opt1 from neuraminidase__InfluenzaB__AHL93668

SEQ ID NO: 91154 - RNA, 1401 nt, Artificial Sequence
  derived and/or modified sequence opt1 from neuraminidase__InfluenzaB__AHL93679
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagaaggcccugcugaucagcccccaccgcuucggcgagaccaaggggaacuccgcgccccucaucauccgggagccguucaucgccugcggccccaacgagugcaagcacuucgcccugacccacuacgccgcgcagcccggcggguacuacaacggcacccgcggggaccggaacaagcugcgccaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagauccugcccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccucaugugcaccgacaccuaccuggacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccucgcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccugaugggcuccgggcagcugcucugggacaccgucaccggcguggacauggcccuguga

SEQ ID NO: 91155 - RNA, 1401 nt, Artificial Sequence; identical to SEQ ID NO: 91148
  derived and/or modified sequence opt1 from neuraminidase__InfluenzaB__AHL93690

SEQ ID NO: 91156 - RNA, 1401 nt, Artificial Sequence; identical to SEQ ID NO: 91148
  derived and/or modified sequence opt1 from neuraminidase__InfluenzaB__AHL93701

SEQ ID NO: 91157 - RNA, 1401 nt, Artificial Sequence; identical to SEQ ID NO: 91148
  derived and/or modified sequence opt1 from neuraminidase__InfluenzaB__AHL93712

SEQ ID NO: 91158 - RNA, 1401 nt, Artificial Sequence
  derived and/or modified sequence opt1 from neuraminidase__InfluenzaB__AHL93723
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaccacgggccccugcgaguccaacggcgacaaggggagcggcgggaucaagggcggguucgugcaccagcgcauggccuccaagaucggccggugguacagccgcaccauguccaagaccgagcggaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagacguggcacuccgccgccaccgccaucuacugccugaugggcagcgggcagcuccugugggacaccgugaccggcgucgacauggcccuguga

SEQ ID NO: 91159 - RNA, 1401 nt, Artificial Sequence; identical to SEQ ID NO: 89964
  derived and/or modified sequence opt1 from neuraminidase__InfluenzaB__AHL93734

SEQ ID NO: 91160 - RNA, 1401 nt, Artificial Sequence
  derived and/or modified sequence opt1 from neuraminidase__InfluenzaB__AHL93745
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacgugcuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucguccaccagcgcauggccuccaagaucggccggugguacagccgcacgauguccaagaccgagcggaagggcauggggcucuacgugaaguacgacggcgaccccuggaccgacagcgacgcccuggcguuccgcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 91161 - RNA, 1401 nt, Artificial Sequence; identical to SEQ ID NO: 90127
  derived and/or modified sequence opt1 from neuraminidase__InfluenzaB__AHL93756

SEQ ID NO: 91162 - RNA, 1401 nt, Artificial Sequence; identical to SEQ ID NO: 91148
  derived and/or modified sequence opt1 from neuraminidase__InfluenzaB__AHL93767

SEQ ID NO: 91163 - RNA, 1401 nt, Artificial Sequence
  derived and/or modified sequence opt1 from neuraminidase__InfluenzaB__AHL93778
augcugcccagcaccauccagacccucauccuguuccugacguccggcggggugcuccugagccuguacgucuccgcccuccugagcuaccugcucuacuccgacauccugcugaaguucagcccgaccgagaucaccgcccccaccaugucccucgacugcgcgaacgccagcaacgugcaggccgugaaccgcuccgccacgaagggcgucaccuuccugcugcccgagcccgaguggaccuacccgcggcucagcugccccggguccaucuuccagaaggcccugcugaucagcccccaccgcuucggcgagaccaaggggaacuccgcgccccucaucauccgggagccguucaucgccugcggccccaacgagugcaagcacuucgcccugacgcacuacgccgcgcagcccggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggaccuacaucggcgucgacgggccggacaacgacgcccugcucaaggugaaguacggcgaggcguacacggacaccuaccacagcuacgccaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccacggggcgggucaagcacaccgaggagugcacgugcggcuucgccagcaacaagaccaucgagugcgcgugccgcgacaacuccuacaccgccaagcggcccuucgugaagcugaacguggagaccgacaccgccgagauccgccugaugugcaccgacacguaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccaccgccaucuacugccucaugggcuccgggcagcugcugugggacaccgucacgggcguggacauggcccucuga

SEQ ID NO: 91164 - RNA, 1401 nt, Artificial Sequence
  derived and/or modified sequence opt1 from neuraminidase__InfluenzaB__AHL93789
augcugcccagcaccauccagacccucacgcuguuccugaccuccggcggggugcuccugagccuguacgucuccgccagccucuccuaccugcuguacagcgacauccuccugaaguucuccccgaccggcaucaccgcccccacgaugccccuggacugcgcgaacgccagcaacgugcaggccgugaaccgcuccgccaccaagggggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaaggugaaguacggggaggcguacaccgacaccuaccacagcuacgccaacaagauccugcggacgcaggaguccgccugcaacugcaucggcggcaacugcuaccugauggugaccgacgggagcgccagcggcgucuccgagugccgcuuccucaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacggcagcaucacgggccccugcgaguccaacggggacaagggcagcgggggcaucaagggcggguucgugcaccagcgcauggaguccaagaucggccggugguacagccgcaccauguccaagaccgagcggauggggaugggccuguacgugaaguacgacggggaccccugggccgacagcgacgcccuggucuucuccggcgugauggugagcaugaaggagccggggugguacuccuucggcuucgagaucaaggacaagaagugcgacguccccugcaucggcaucgagauggugcacgacgggggcaaggagaccuggcacagcgcggccacggccaucuacugccucaugggguccggccagcugcugugggacaccgugaccggcgucgacauggcccucuga

SEQ ID NO: 91165 - RNA, 1401 nt, Artificial Sequence; identical to SEQ ID NO: 89964
  derived and/or modified sequence opt1 from neuraminidase__InfluenzaB__AHL93800

SEQ ID NO: 91166 - RNA, 1401 nt, Artificial Sequence; identical to SEQ ID NO: 89964
  derived and/or modified sequence opt1 from neuraminidase__InfluenzaB__AHL93811

SEQ ID NO: 91167 - RNA, 1401 nt, Artificial Sequence; identical to SEQ ID NO: 90500
  derived and/or modified sequence opt1 from neuraminidase__InfluenzaB__AHL93822

SEQ ID NO: 91168 - RNA, 1401 nt, Artificial Sequence; identical to SEQ ID NO: 89964
  derived and/or modified sequence opt1 from neuraminidase__InfluenzaB__AHL93833

SEQ ID NO: 91169 - RNA, 1401 nt, Artificial Sequence
  derived and/or modified sequence opt1 from neuraminidase__InfluenzaB__AHL93844
augcugcccagcaccauccagacccucacgcuguuccugaccuccggcggggugcuccugagccuguacgucuccgccagccucuccuaccugcuguacagcggcauccuccugaaguucuccccgaccgagaucaccgcccccacgaugccccuggacugcgcgaacgccagcaacgugcaggccgugaaccgcuccgccaccaaggaggucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacgacaacgcccugcucaaggugaaguacggcgaggcguacaccgacaccuaccacagcuacgcccacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 91170 - RNA, 1401 nt, Artificial Sequence; identical to SEQ ID NO: 89964
  derived and/or modified sequence opt1 from neuraminidase__InfluenzaB__AHL93855

SEQ ID NO: 91171 - RNA, 1401 nt, Artificial Sequence; identical to SEQ ID NO: 89964
  derived and/or modified sequence opt1 from neuraminidase__InfluenzaB__AHL93866

SEQ ID NO: 91172 - RNA, 1401 nt, Artificial Sequence; identical to SEQ ID NO: 89964
  derived and/or modified sequence opt1 from neuraminidase__InfluenzaB__AHL93877

SEQ ID NO: 91173 - RNA, 1401 nt, Artificial Sequence; identical to SEQ ID NO: 89964
  derived and/or modified sequence opt1 from neuraminidase__InfluenzaB__AHL93888

SEQ ID NO: 91174 - RNA, 1401 nt, Artificial Sequence
  derived and/or modified sequence opt1 from neuraminidase__InfluenzaB__AHL93899
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcgagcccaacgagugcaagcacuucgcccucacccacuacgccgcgcagcccggcggcuacuacaacgggacccgcggcgaccggaacaagcugcgccaccugaucagcgugaagcucgggaagaucccgaccguggagaacuccaucuuccacauggccgccuggagcggcuccgccugccacgacgggaaggaguggacguacaucggcgucgacggccccgacaacaacgcccugcugaagaucaaguacggggaggcguacaccgacaccuaccacagcuacgccaacaacauccuccggacccaggaguccgccugcaacugcaucggcgggaacugcuaccugaugaucacggacggcagcgccagcggcguguccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacggcagcaccacggggcccugcgaguccaacggcgacaagggcagcgggggcaucaagggcggguucgugcaccagcgcauggccuccaagaucgggcggugguacagccgcaccauguccaagaccgagcggaagggcaugggccucuacgucaaguacgacggggaccccuggaccgacagcgacgcccuggcguuccgcggcgugaugguguccaugaaggagccggggugguacagcuucggcuucgagaucaaggacaagaagugcgacguccccugcaucgggaucgagauggugcacgacggcggcaaggagacguggcacuccgccgccaccgccaucuacugccugauggggagcggccagcuccugugggacaccgugaccggggucgacauggcccuguga

SEQ ID NO: 91175 - RNA, 1401 nt, Artificial Sequence
  derived and/or modified sequence opt1 from neuraminidase__InfluenzaB__AHL93910
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcacgugccgcgacaacuccuacaccgcgaagcggcccuucgucaagcucaacguggagaccgacaccgccgagauccgccugaugugcaccgacaccuaccuggacaccccgcggcccgacgacgggggcaucacgggccccugcgagagcaacggggacaagggcuccgggggcaucaagggcggguucgugcaccagcgcauggccagcaagaucggccggugguacucccgcaccaugagcaagaccgagcggaaggggaugggccucuacgucaaguacgacggggaccccuggaccgacuccgacgcccuggccuuccgcggcgugauggugagcaugaaggagccggggugguacuccuucggcuucgagaucaaggacaagaagugcgacguccccugcaucggcaucgagauggugcacgacgggggcaaggagacguggcacagcgcggccaccgccaucuacugccugaugggguccggccagcuccugugggacaccgugaccggcgucgacauggcccuguga

SEQ ID NO: 91176 - RNA, 1401 nt, Artificial Sequence; identical to SEQ ID NO: 89964
  derived and/or modified sequence opt1 from neuraminidase__InfluenzaB__AHL93921

SEQ ID NO: 91177 - RNA, 1401 nt, Artificial Sequence
  derived and/or modified sequence opt1 from neuraminidase__InfluenzaB__AHL93932
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggagcuguacgugaaguacgacggggaccccugggccgacagcgacgcccuggcguucuccggcgucauggugagcaugaaggagccggggugguacuccuucggcuucgagaucaaggacaagaagugcgacgugcccugcaucgggaucgagaugguccacgacggcggcaaggagaccuggcacagcgccgccacggccaucuacugccucaugggguccggccagcugcugugggacaccgugaccgggguggacauggcccucuga

SEQ ID NO: 91178 - RNA, 1401 nt, Artificial Sequence; identical to SEQ ID NO: 90127
  derived and/or modified sequence opt1 from neuraminidase__InfluenzaB__AHL93943

SEQ ID NO: 91179 - RNA, 1401 nt, Artificial Sequence; identical to SEQ ID NO: 89964
  derived and/or modified sequence opt1 from neuraminidase__InfluenzaB__AHL93954

SEQ ID NO: 91180 - RNA, 1401 nt, Artificial Sequence
  derived and/or modified sequence opt1 from neuraminidase__InfluenzaB__AHL93965
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaacugcuccgccacgaagggcgucacccuccugcugcccgagccggaguggaccuacccccgccucagcugccccggguccaccuuccagaaggcgcugcugaucagcccccaccgguucggcgagacgaaggggaacuccgccccgcucaucauccgcgagcccuucaucgccugcggccccaacgagugcaagcacuucgcccugacccacuacgcggcccagcccggcggguacuacaacggcacccgcggggaccggaacaagcugcggcaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgcgagcaacaagaccaucgagugcgccugccgggacaacuccuacaccgccaagcgccccuucgugaagcugaacguggagaccgacaccgccgagauccggcugaugugcacggacaccuaccucgacaccccgcgccccaacgacgggagcaucaccggccccugcgaguccgacggcgacaaggggaacggcgggaucaagggcggguucguccaccagcggauggagagcaagaucggccgcugguacucccggacgaugagcaagaccgagcgcaugggcauggggcuguacgugaaguacgacggcgaccccugggccgacuccgacgcgcuggccuucagcggggugauggucuccaugaaggagccgggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcgcucuga

SEQ ID NO: 91181 - RNA, 1401 nt, Artificial Sequence; identical to SEQ ID NO: 89883
  derived and/or modified sequence opt1 from neuraminidase__InfluenzaB__AHL93976

SEQ ID NO: 91182 - RNA, 1401 nt, Artificial Sequence; identical to SEQ ID NO: 91154
  derived and/or modified sequence opt1 from neuraminidase__InfluenzaB__AHL93987

SEQ ID NO: 91183 - RNA, 1401 nt, Artificial Sequence
  derived and/or modified sequence opt1 from neuraminidase__InfluenzaB__AHL93998
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaucaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcggacccaggagagcgccugcaacugcaucggcggggacugcuaccugaugaucaccgacggccccgccagcggcguguccgagugccgcuuccucaagauccgggaggggcgcaucaucaaggagaucuuccccacgggccgggugaagcacaccgaggagugcacgugcggguucgcgagcaacaagaccaucgagugcgccugccgcgacaaccgguacaccgccaagcgccccuucgucaagcugaacguggagaccgacaccgccgagauccggcugaugugcaccgagacguaccucgacaccccgcgccccaacgacggcuccaucaccgggcccugcgagagcgacggcgacaagggcuccgggggcaucaagggcggguucgugcaccagcggauggccagcaagaucgggcgcugguacucccggaccaugagcaagacgaagcgcaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcgcuguga

SEQ ID NO: 91184 - RNA, 1401 nt, Artificial Sequence
  derived and/or modified sequence opt1 from neuraminidase__InfluenzaB__AHL94009
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgguccgccacgaagggcgucaccuuccuccugcccgagccgaaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugccgccacuucgcccucacccacuacgccgcgcagcccggcggguacuacaacggcacccgcggggaccggaacaagcugcggcaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccgcacccaggaguccgccugcaacugcaucgggggcaacugcuaccugaugaucacggacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcucaacguggagaccgacaccgccgagauccggcugaugugcacggacaccuaccuggacaccccgcgccccgacgacgggagcaucaccggccccugcgaguccaacggcgacaaggggagcggcgggaucaagggcggguucgugcaccagcggauggccuccaagaucggccgcugguacagccggacgauguccaagaccgagcgcaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91185 - RNA, 1401 nt, Artificial Sequence; identical to SEQ ID NO: 89964
  derived and/or modified sequence opt1 from neuraminidase__InfluenzaB__AHL94020

SEQ ID NO: 91186 - RNA, 1401 nt, Artificial Sequence; identical to SEQ ID NO: 89964
  derived and/or modified sequence opt1 from neuraminidase__InfluenzaB__AHL94031

SEQ ID NO: 91187 - RNA, 1401 nt, Artificial Sequence; identical to SEQ ID NO: 90127
  derived and/or modified sequence opt1 from neuraminidase__InfluenzaB__AHL94042

SEQ ID NO: 91188 - RNA, 1401 nt, Artificial Sequence
  derived and/or modified sequence opt1 from neuraminidase__InfluenzaB__AHL94053
augcugcccagcaccauccagacccucacgcuguuccugaccuccggcggggugcuccugagccuguaccucuccgcccugcugagcuaccuccuguacuccgacauccugcucaaguucagcccgaccgagaucaccgcccccacgaugucccuggacugcgcgaacgccagcaacguccaggccgugaaccgcuccgccaccaagggcgugaccuuccugcuccccgagcccgaguggaccuacccgcggcugagcugccccggguccacguuccagcgcgcccugcucaucagcccccaccgguucggcgagaccaaggggaacuccgcgccccugaucauccgcgagccguucaucgccugcggccccaacgagugcaagcacuucgcccugacccacuacgccgcgcagcccggcggguacuacaacggcacccgcggggaccggaacaagcuccggcaccugaucagcgucaagcugggcaagauccccacgguggagaacuccaucuuccacauggccgccuggagcggguccgccugccacgacggcaaggaguggaccuacaucggcguggacgggccggacaacgacgcccuccugaaggucaaguacggcgaggcguacaccgacaccuaccacagcuacgccaacaagauccugcgcacgcaggaguccgccugcaacugcaucgggggcaacugcuaccucaugaucaccgacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcugaacguggagaccgacacggccgagauccggcucaugugcaccgacaccuaccuggacacgccccgcccggacgacgggagcaucaccggccccugcgaguccaacggcgacaaggggagcggcgggaucaagggcggguucgugcaccagcggauggaguccaagaucggccgcugguacagccggaccauguccaagaccgagcgcaugggcauggggcuguacgucaaguacgacggcgaccccugggccgacagcgacgcccucgcguucuccggggugauggugagcaugaaggagcccggcugguacuccuucggguucgagaucaaggacaagaagugcgacgucccgugcaucggcaucgagauggugcacgacggcgggaaggagaccuggcacagcgccgccacggccaucuacugccugaugggcuccgggcagcugcucugggacaccgugaccggcgucgacauggcccuguga

SEQ ID NO: 91189 - RNA, 1401 nt, Artificial Sequence; identical to SEQ ID NO: 89964
  derived and/or modified sequence opt1 from neuraminidase__InfluenzaB__AHL94064

SEQ ID NO: 91190 - RNA, 1401 nt, Artificial Sequence; identical to SEQ ID NO: 89964
  derived and/or modified sequence opt1 from neuraminidase__InfluenzaB__AHL94075

SEQ ID NO: 91191 - RNA, 1401 nt, Artificial Sequence
  derived and/or modified sequence opt1 from neuraminidase__InfluenzaB__AHL94086
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucaccuuccuccugcccgagcccgaguggaccuacccgcgccugagcugccccggguccaccuuccagaaggcccuccugaucagcccccaccgguucggcgagacgaaggggaacuccgcgccccugaucauccgcgagccguucguggccugcggccccaaggagugcaagcacuucgcccucacccacuacgccgcgcagcccggcggguacuacaacggcacccgggaggaccgcaacaagcugcggcaccugaucagcgugaagcucgggaagauccccaccgucgagaacuccaucuuccacauggccgccuggagcggcuccgccugccacgacgggcgcgaguggacguacaucggcguggacggcccggacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacggagaccuaccuggacaccccgcggcccaacgacggcagcaucaccgggcccugcgaguccaacggcgacaagggcagcgggggcaucaagggcggguucgugcaccagcgcauggccuccaagaucgggcggugguacagccgcacgauguccaagaccaagcggaugggcaugggccucuacgucaaguacgacggggaccccuggaccgacagcgaggcccuggcgcuguccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91192 - RNA, 1401 nt, Artificial Sequence; identical to SEQ ID NO: 90127
  derived and/or modified sequence opt1 from neuraminidase__InfluenzaB__AHL94095

SEQ ID NO: 91193 - RNA, 1401 nt, Artificial Sequence; identical to SEQ ID NO: 89964
  derived and/or modified sequence opt1 from neuraminidase__InfluenzaB__AHL94106

SEQ ID NO: 91194 - RNA, 1401 nt, Artificial Sequence
  derived and/or modified sequence opt1 from neuraminidase__InfluenzaB__AHL94117
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcuccacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucaacauggcccuguga

SEQ ID NO: 91195 - RNA, 1401 nt, Artificial Sequence; identical to SEQ ID NO: 89964
  derived and/or modified sequence opt1 from neuraminidase__InfluenzaB__AHL94128

SEQ ID NO: 91196 - RNA, 1401 nt, Artificial Sequence
  derived and/or modified sequence opt1 from neuraminidase__InfluenzaB__AHL94139
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcccgagcccgaguggaccuacccgcggcucagcugccccggguccacguuccagcgcgcccugcugaucagcccccaccgguucggcgagaccaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucagcgugaagcugggcaagauccccacgguggagaacuccaucuuccacauggccgccuggagcggguccgccugccacgacggcaaggaguggaccuacaucggcgucgacgggccggacaacgacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagaucaagcugaugugcaccgacaccuaccucgacacgccccggccggacgacgggagcaucaccggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccucaugggcuccgggcagcugcugugggacaccgucaccggcguggacauggcccucuga

SEQ ID NO: 91197 - RNA, 1401 nt, Artificial Sequence; identical to SEQ ID NO: 91154
  derived and/or modified sequence opt1 from neuraminidase__InfluenzaB__AHL94150

SEQ ID NO: 91198 - RNA, 1401 nt, Artificial Sequence
  derived and/or modified sequence opt1 from neuraminidase__InfluenzaB__AHL94161
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccaagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91199 - RNA, 1401 nt, Artificial Sequence; identical to SEQ ID NO: 91154
  derived and/or modified sequence opt1 from neuraminidase__InfluenzaB__AHL94183

SEQ ID NO: 91200 - RNA, 1404 nt, Artificial Sequence
  derived and/or modified sequence opt1 from neuraminidase__InfluenzaB__AHL94194
augcugcccagcaccauccagacccucacgcuguuccugaccuccggcggggugcuccugagccuguacgucuccgcccuccugagcuaccugcucuacuccgacauccugcugaaguucagcccgaccgagaucaccgcccccacgaugucccucgacugcgcgaacgccagcaacgugcaggccgugaaccgcuccgccaccaagggcgucaccuuccugcugcuccccgagcccgaguggaccuacccgcggcugagcugccccggguccacguuccagcgcgcccugcucaucagcccccaccgguucggcgagaccaaggggaacuccgcgccccugaucauccgcgagccguucaucgccugcggccccaacgagugcaagcacuucgcccugacccacuacgccgcgcagcccggcggguacuacaacggcacccgcggggaccggaacaagcuccggcaccugaucagcgugaagcugggcaagauccccacgguggagaacuccaucuuccacauggccgccuggagcggguccgccugccacgacggcaaggaguggaccuacaucggcgucgacgggccggacaacgacgcccuccugaaggugaaguacggcgaggcguacaccgacaccuaccacagcuacgccaacaagauccugcgcacgcaggaguccgccugcaacugcaucgggggcaacugcuaccucaugaucaccgacggcagcgccagcgggguguccgagugccgguuccugaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacacggccgagauccggcucaugugcaccgacaccuaccuggacacgccccgcccggacgacgggagcaucaccggccccugcgaguccaacggcgacaaggggagcggcgggaucaagggcggguucguccaccagcggauggaguccaagaucggccgcugguacagccggaccauguccaagaccgagcgcaugggcauggggcuguacgugaaguacgacggcgaccccugggccgacagcgacgcccucgcguucuccggggugauggucagcaugaaggagcccggcugguacuccuucggguucgagaucaaggacaagaagugcgacgugccgugcaucggcaucgagauggugcacgacggcgggaaggagaccuggcacagcgccgccacggccaucuacugccugaugggcuccgggcagcugcucugggacaccgucaccggcguggacauggcccuguga

SEQ ID NO: 91201 - RNA, 1401 nt, Artificial Sequence; identical to SEQ ID NO: 89964
  derived and/or modified sequence opt1 from neuraminidase__InfluenzaB__AHL94205

SEQ ID NO: 91202 - RNA, 1401 nt, Artificial Sequence; identical to SEQ ID NO: 90127
  derived and/or modified sequence opt1 from neuraminidase__InfluenzaB__AHL94214

SEQ ID NO: 91203 - RNA, 1401 nt, Artificial Sequence
  derived and/or modified sequence opt1 from neuraminidase__InfluenzaB__AHL94224
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaagggcauggggcucuacgucaaguacgacggcgaccccuggaucgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccaccgccaucuacugccugaugggcagcgggcagcuccugugggacacggugaccggcgucgacauggcccuguga

SEQ ID NO: 91204 - RNA, 1401 nt, Artificial Sequence; identical to SEQ ID NO: 89964
  derived and/or modified sequence opt1 from neuraminidase__InfluenzaB__AHL94235

SEQ ID NO: 91205 - RNA, 1401 nt, Artificial Sequence; identical to SEQ ID NO: 90127
  derived and/or modified sequence opt1 from neuraminidase__InfluenzaB__AHL94246

SEQ ID NO: 91206 - RNA, 1401 nt, Artificial Sequence; identical to SEQ ID NO: 90127
  derived and/or modified sequence opt1 from neuraminidase__InfluenzaB__AHL94257

SEQ ID NO: 91207 - RNA, 1401 nt, Artificial Sequence; identical to SEQ ID NO: 89825
  derived and/or modified sequence opt1 from neuraminidase__InfluenzaB__AHL94267

SEQ ID NO: 91208 - RNA, 1401 nt, Artificial Sequence; identical to SEQ ID NO: 89825
  derived and/or modified sequence opt1 from neuraminidase__InfluenzaB__AHL94278

SEQ ID NO: 91209 - RNA, 1401 nt, Artificial Sequence; identical to SEQ ID NO: 89825
  derived and/or modified sequence opt1 from neuraminidase__InfluenzaB__AHL94299

SEQ ID NO: 91210 - RNA, 1401 nt, Artificial Sequence
  derived and/or modified sequence opt1 from neuraminidase__InfluenzaB__AHL94310
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggcagcgccuccggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcucaacgucgagaccgacaccgccgagauccgccugaugugcacggagaccuaccuggacaccccgcggcccaacgacggcuccaucgccgggcccugcgagagcaacggcgacgagggcuccgggggcaucaagggcggguucgugcaccagcgcauggccagcaagaucgggcggugguacucccgcaccaugagcaagacgaagcggaugggcaugggccucuacgugaaguacgacggggaccccuggaccgacuccgaggcgcuggcccugagcggcgucaugguguccauggaggagccggggugguacagcuucggcuucgagaucaaggacaagaagugcgacgugcccugcaucgggaucgagaugguccacgacggcggcaagaccaccuggcacuccgccgccacggccaucuacugccucauggggagcggccagcugcugugggacaccgugaccggggugaacaugacccucuga

SEQ ID NO: 91211 - RNA, 1401 nt, Artificial Sequence; identical to SEQ ID NO: 91210
  derived and/or modified sequence opt1 from neuraminidase__InfluenzaB__AHL94321

SEQ ID NO: 91212 - RNA, 1401 nt, Artificial Sequence
  derived and/or modified sequence opt1 from neuraminidase__InfluenzaB__AHL94332
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgugaagcucaacgucgagaccgacaccgccgagauccgccugaugugcacggagaccuaccuggacacgccccggcccaacgacggcagcaucaccgggcccugcgaguccaacggcgacgagggcagcgggggcaucaagggcggguucgugcaccagcgcauggccuccaagaucgggcggugguacagccgcaccauguccaagaccaagcggaugggcaugggccucuacgugaaguacgacggggacccguggaccgacagcgaggcccuggcgcuguccggcgucauggugagcauggaggagcccgggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccggggugaacaugacgcucuga

SEQ ID NO: 91213 - RNA, 1401 nt, Artificial Sequence; identical to SEQ ID NO: 89825
  derived and/or modified sequence opt1 from neuraminidase__InfluenzaB__AHL94343

SEQ ID NO: 91214 - RNA, 1401 nt, Artificial Sequence
  derived and/or modified sequence opt1 from neuraminidase__InfluenzaB__AHL94354
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91215 - RNA, 1401 nt, Artificial Sequence; identical to SEQ ID NO: 91214
  derived and/or modified sequence opt1 from neuraminidase__InfluenzaB__AHL94365

SEQ ID NO: 91216 - RNA, 1401 nt, Artificial Sequence
  derived and/or modified sequence opt1 from neuraminidase__InfluenzaB__AHL94387
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaccgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacgcgcggggaccggaacaagcugcgccaccucaucagcgugaagcugggcaagaucccgaccguggagaacuccaucuuccacauggccgccuggagcggguccgccugccacgacggcaaggaguggaccuaccugggcgucgacgggcccgacaacaacgcccuccugaaggugaaguacggcgaggcguacaccgacacguaccacagcuacgccaacaagauccugcggacccaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggucaagcacacggaggagugcacgugcggcuucgccagcaacaagaccaucgagugcgcgugccgcgacaaccgguacaccgccaagcgccccuucgugaagcugaacguggagaccgacaccgccgagauccggcucaugugcaccgacaccuaccuggacacgccgcgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccucgcguucagcggggugauggucuccaugaaggagccgggcugguacagcuucggguucgagaucaaggacaagaagugcgacgugcccugcaucggcaucgagauggugcacgacggcgggaaggagaucuggcacuccgccgccacggccaucuacugccugaugggcagcgggcagcugcucugggacaccgucaccggcguggacauggcccuguga

SEQ ID NO: 91217 - RNA, 1404 nt, Artificial Sequence
  derived and/or modified sequence opt1 from neuraminidase__InfluenzaB__AHL94398
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaacgagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaaggugaaguacggcgaggcguacaccgacaccuaccacagcuacgccaacaagauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcucaugugcaccgacaccuaccuggacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccucgcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccugaugggcagcgggcagcugcucugggacaccgucaccggcguggacauggcccuguga

SEQ ID NO: 91218 - RNA, 1401 nt, Artificial Sequence; identical to SEQ ID NO: 91214
  derived and/or modified sequence opt1 from neuraminidase__InfluenzaB__AHL94409

SEQ ID NO: 91219 - RNA, 1401 nt, Artificial Sequence
  derived and/or modified sequence opt1 from neuraminidase__InfluenzaB__AHL94431
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcucauccugcccgagcccgaguggaccuacccgcgccugagcugccccggguccaccuuccagaaggcgcuccugaucagcccccaccgguucggcgagaucaaggggaacuccgcgccccugaucauccgcgagccguucaucgccugcggccccaccgagugcaagcacuucgcccucacgcacuacgccgcccagcccggcggguacuacaacggcacccgggaggaccgcaacaagcugcggcaccugaucagcgugaagcucgggaagauccccaccguggagaacuccaucuuccacauggccgccuggagcggcuccgccugccacgacgggaaggaguggaccuacaucggcgucgacggcccggacagcaacgcgcugcugaagaucaaguacggggaggccuacacggacaccuaccacuccuacgccaagaacauccuccgcacccaggagagcgccugcaacugcaucggcggggacugcuaccugaugaucaccgacggccccgccagcggcguguccgagugccgguuccugaagauccgcgaggggcggaucaucaaggagaucuuccccacgggccgcgugaagcacaccgaggagugcacgugcggguucgcgagcaacaagaccaucgagugcgccugccgggacaaccgcuacaccgccaagcggcccuucgucaagcucaacguggagaccgacaccgccgagauccgccugaugugcaccgagacguaccuggacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccucuacgucaaguacgacggggaccccuggaccgacuccgaggcgcuggcccugagcggcgugaugaucuccauggaggagccggggugguacagcuucggcuucgagaucaaggacaagaagugcgacgugcccugcaucgggaucgagaugguccacgacggcggcaagaccaccuggcacuccgccgccacggccaucuacugccucauggggagcggccagcugcugugggacaccgugaccgggguggacauggcgcucuga

SEQ ID NO: 91220 - RNA, 1401 nt, Artificial Sequence
  derived and/or modified sequence opt1 from neuraminidase__InfluenzaB__AHL94442
augcugcccagcaccauccagacccucacgcuguuccugaccuccggcggggugcuccugagccuguacauguccgccagccucuccuaccugcuguacagcgacauccuccugaaguucucccgcaccgagaucaccgccccgaucaugccccuggacugcgcgaacgccagcaacguccaggccgugaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgucaagcucgggaagaucccgaccguggagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggcagcgccuccggcaucagcgagugccgcuuccugaagauccgggaggggcgcaucaucaaggagaucuuccccaccggccgggucaagcacaccgaggagugcacgugcggguucgccuccaacaagaccaucgagugcgcgugccgcgacaacagcuacaccgccaagcggcccuucgugaagcucaacguggagaccgacaccgccgagauccgccugaugugcacggagaccuaccuggacaccccgcggcccaacgacggcuccaucgccgggcccugcgagagcaacggcgacgagggcuccgggggcaucaagggcggguucguccaccagcgcauggccagcaagaucgggcggugguacucccgcaccaugagcaagacgaagcggaugggcaugggccucuacgugaaguacgacggggaccccuggaccgacuccgaggcgcuggcccugagcggcgugauggucuccauggaggagccggggugguacagcuucggcuucgagaucaaggacaagaagugcgacgugcccugcaucgggaucgagauggugcacgacggcggcaagaccaccuggcacuccgccgccacggccaucuacugccucauggggagcggccagcugcugugggacaccgucaccggggugaacaugacccucuga

SEQ ID NO: 91221 - RNA, 1401 nt, Artificial Sequence; identical to SEQ ID NO: 91210
  derived and/or modified sequence opt1 from neuraminidase__InfluenzaB__AHL94464

SEQ ID NO: 91222 - RNA, 1401 nt, Artificial Sequence; identical to SEQ ID NO: 89825
  derived and/or modified sequence opt1 from neuraminidase__InfluenzaB__AHL94475

SEQ ID NO: 91223 - RNA, 1401 nt, Artificial Sequence; identical to SEQ ID NO: 91214
  derived and/or modified sequence opt1 from neuraminidase__InfluenzaB__AHL94486

SEQ ID NO: 91224 - RNA, 1401 nt, Artificial Sequence; identical to SEQ ID NO: 89825
  derived and/or modified sequence opt1 from neuraminidase__InfluenzaB__AHL94497

SEQ ID NO: 91225 - RNA, 1401 nt, Artificial Sequence; identical to SEQ ID NO: 91210
  derived and/or modified sequence opt1 from neuraminidase__InfluenzaB__AHL94508

SEQ ID NO: 91226 - RNA, 1401 nt, Artificial Sequence
  derived and/or modified sequence opt1 from neuraminidase__InfluenzaB__AHL94519
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucguccaccagcgcauggaguccaagaucggccggugguacagccgcaccauguccaagaccgagcggaugggcauggggcuguacgugaaguacgacggcgaccccuggaccgacagcgacgcccuggccuucuccggggugauggucagcaugaaggagccgggcugguacuccuucggguucgagaucaaggacaagaagugcgacgugcccugcaucggcaucgagauggugcacgacggcgggaaggagacguggcacagcgcggccaccgccaucuacugccucaugggcuccgggcagcugcugugggacaccgucaccggcguggacauggcccucuga

SEQ ID NO: 91227 - RNA, 1401 nt, Artificial Sequence; identical to SEQ ID NO: 91210
  derived and/or modified sequence opt1 from neuraminidase__InfluenzaB__AHL94530

SEQ ID NO: 91228 - RNA, 1401 nt, Artificial Sequence; identical to SEQ ID NO: 91214
  derived and/or modified sequence opt1 from neuraminidase__InfluenzaB__AHL94541

SEQ ID NO: 91229 - RNA, 1401 nt, Artificial Sequence
  derived and/or modified sequence opt1 from neuraminidase__InfluenzaB__AHL94563
augcugcccagcaccauccagacccucacgcuguuccugacccucggcggggugcugcugucccucuacgucagcgccucccugagcuaccugcucuacuccgacauccugcugaaguucagccgcaccgagaucaccgccccgaucaugccccucgacugcgcgaacgccuccaacgugcaggccgugaaccggagcgccacgaagggcgucacccugcugcuccccgagcccgaguggaccuacccgcgccuguccugccccgggagcaccuuccagaaggcccugcucaucagcccccaccgguucggcgagacgaaggggaacuccgcgccccugaucauccgcgagccguucaucgccugcggccccaaggagugcaagcacuucgcccugacccacuacgccgcgcagcccggcggguacuacaacggcacccgggaggaccgcaacaagcuccggcaccugaucuccgugaagcuggggaagauccccaccguggagaacagcaucuuccacauggccgccugguccggcagcgccugccacgacgggcgcgaguggacguacaucggcgucgacggcccggacuccaacgcccuccugaagaucaaguacggggaggcguacaccgacaccuaccacagcuacgccaagaacauccugcggacccaggaguccgccugcaacugcaucggcggggacugcuaccucaugaucacggacggccccgccagcggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcugaacgucgagaccgacaccgccgagauccgccucaugugcacggagaccuaccuggacaccccgcggcccaacgacggcuccaucaccgggcccugcgagagcaacggcgacaagggcuccgggggcaucaagggcggguucgugcaccagcgcauggccagcaagaucgggcggugguacucccgcacgaugagcaagaccaagcggaugggcaugggccuguacgugaaguacgacggggaccccuggaccgacuccgaggcccucgcgcugagcggcgucaugguguccauggaggagccggggugguacagcuucggcuucgagaucaaggacaagaagugcgacgugcccugcaucgggaucgagaugguccacgacggcggcaagaccacguggcacuccgccgccaccgccaucuacugccugauggggagcggccagcuccugugggacaccgugaccggggugaacaugacgcuguga

SEQ ID NO: 91230 - RNA, 1401 nt, Artificial Sequence; identical to SEQ ID NO: 91183
  derived and/or modified sequence opt1 from neuraminidase__InfluenzaB__AHL94574

SEQ ID NO: 91231 - RNA, 1401 nt, Artificial Sequence
  derived and/or modified sequence opt1 from neuraminidase__InfluenzaB__AHL94585
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaucaaggggaacuccgcgccccucaucauccgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcggacccaggagagcgccugcaacugcaucggcggggacugcuaccugaugaucaccgacggccccgccagcggcguguccgagugccgcuuccucaagauccgggaggggcgcaucaucaaggagaucuuccccaagggccgggugaagcacacggaggagugcacgugcggguucgcgagcaacaagaccaucgagugcgccugccgcgacaaccgguacaccgccaagcgccccuucgucaagcugaacguggagaccgacaccgccgagauccggcugaugugcaccgagaccuaccucgacacgccgcgccccaacgacggcuccaucaccgggcccugcgagagcgacggcgacaagggcuccgggggcaucaagggcggguucgugcaccagcggauggccagcaagaucgggcgcugguacucccggaccaugagcaagaccaagcgcaugggcaugggccuguacgucaaguacgacggggaccccuggacggacuccgaggcgcuggcccucagcggcgugaugguguccauggaggagccggggugguacagcuucggcuucgagaucaaggacaagaagugcgacguccccugcaucgggaucgagauggugcacgacggcggcaagaccaccuggcacuccgccgccaccgccaucuacugccugauggggagcggccagcugcucugggacacggugaccggggucgacauggcgcuguga

SEQ ID NO: 91232 - RNA, 1401 nt, Artificial Sequence; identical to SEQ ID NO: 91183
  derived and/or modified sequence opt1 from neuraminidase__InfluenzaB__AHL94596

SEQ ID NO: 91233 - RNA, 1401 nt, Artificial Sequence
  derived and/or modified sequence opt1 from neuraminidase__InfluenzaB__AHL94607
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggcucaagagcaagaucggccgcugguacucccggaccaugagcaagaccgagcgcaugggcauggggcuguacgugaaguacgacggcgaccccugggccgacuccgacgcccugaccuucagcggggugauggucuccaugaaggagccgggcugguacagcuucggguucgagaucaaggacaagaagugcgacgugcccugcaucggcaucgagauggugcacgacggcgggaaggagacguggcacuccgcggccaccgccaucuacugccugaugggcagcgggcagcugcucugggacaccgucaccggcguggacauggcccuguga

SEQ ID NO: 91234 - RNA, 1401 nt, Artificial Sequence; identical to SEQ ID NO: 91214
  derived and/or modified sequence opt1 from neuraminidase__InfluenzaB__AHL94618

SEQ ID NO: 91235 - RNA, 1401 nt, Artificial Sequence; identical to SEQ ID NO: 91210
  derived and/or modified sequence opt1 from neuraminidase__InfluenzaB__AHL94628

SEQ ID NO: 91236 - RNA, 1401 nt, Artificial Sequence; identical to SEQ ID NO: 91214
  derived and/or modified sequence opt1 from neuraminidase__InfluenzaB__AHL94639

SEQ ID NO: 91237 - RNA, 1401 nt, Artificial Sequence
  derived and/or modified sequence opt1 from neuraminidase__InfluenzaB__AHL94650
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucauccgggagaucuuccccaccgggcgcgucaagcacaccgaggagugcacgugcggcuucgccagcaacaagaccaucgagugcgcgugccgggacaaccgcuacaccgccaagcggcccuucgugaagcugaacguggagaccgacacggccgagauccgccugaugugcaccgacaccuaccucgacaccccgcggcccaacgacggguccaucacgggccccugcgagagcgacggcgacaagggguccggcgggaucaagggcggguucguccaccagcgcaugaaguccaagaucggccggugguacagccgcaccaugagcaagaccgagcggaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91238 - RNA, 1401 nt, Artificial Sequence
  derived and/or modified sequence opt1 from neuraminidase__InfluenzaB__AHL94661
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggauccagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccaagaccuaccucgacaccccgcggcccgaggacgggagcaucacgggccccugcgaguccaacggcgggaagggcagcgggggcaucaagggcggguucgugcaccagcgcauggccuccaagaucggccggugguacagccgcaccauguccaagaccgagcggaaggggaugggccuguacgugaaguacaacggggaccccugggccgacagcgacgcgcuggucuucuccggcgugauggugagcauggaggagccggggugguacuccuucggcuucgagaucaaggacaagaagugcgacguccccugcaucggcaucgagauggugcacgacgggggcaaggagaccuggcacagcgccgccacggccaucuacugccucaugggguccggccagcugcugugggacaccgugaccggcgucaacaugacccucuga

SEQ ID NO: 91239 - RNA, 1401 nt, Artificial Sequence
  derived and/or modified sequence opt1 from neuraminidase__InfluenzaB__AHL94672
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggcagcgccuccggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcucaacgucgagaccgacaccgccgagauccgccugaugugcacggagaccuaccuggacaccccgcggcccaacgacggcuccaucagcgggcccugcgaguccaacggcgacgagggcagcgggggcaucaagggcggguucgugcaccagcgcauggccuccaagaucgggcggugguacagccgcaccauguccaagacgaagcggaugggcaugggccucuacgugaaguacgacggggaccccuggaccgacagcgaggcccuggcgcuguccggcgucauggugagcauggaggagccggggugguacuccuucggcuucgagaucaaggacaagaagugcgacgugcccugcaucgggaucgagaugguccacgacggcggcaagaccaccuggcacagcgccgccacggccaucuacugccucaugggguccggccagcugcugugggacaccgugaccggggugaacaugacccucuga

SEQ ID NO: 91240 - RNA, 1401 nt, Artificial Sequence
  derived and/or modified sequence opt1 from neuraminidase__InfluenzaB__AHL94683
augcugcccagcaccauccagacccucacgcuguuccugaccuccggcggggugcuccugagccuguacgucuccgccagccucuccuaccugcuguacagcgacauccuccugaaguucucccgcaccgagaucaccgccccgaucaugccccuggacugcgcgaacgccagcaacgugcaggccgugaaccgguccgccacgaagggcgucacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggcagcgccuccggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgugaagcucaacgucgagaccgacaccgccgagauccgccugaugugcacggagaccuaccuggacaccccgcggcccaacgacggcuccaucaccgggcccugcgagagcaacggcggcgagggguccggcgggaucaagggcggguucgugcaccagcgcauggccagcaagaucggccggugguacucccgcacgaugagcaagaccaagcggaugggcauggggcucuacgugaaguacgacggcgaccccuggaccgacuccgaggcccuggcgcugagcggggucaugguguccauggaggagccgggcugguacagcuucggguucgagaucaaggacaagaagugcgacgugcccugcaucggcaucgagaugguccacgacggcgggaagaccacguggcacuccgccgccaccgccaucuacugccucaugggcagcgggcagcugcugugggacaccgugaccggcgugaacaugacgcucuga

SEQ ID NO: 91241 - RNA, 1401 nt, Artificial Sequence
  derived and/or modified sequence opt1 from neuraminidase__InfluenzaB__AHL94694
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccugaccuucagcggggugauggucuccaugaaggagccgggcugguacagcuucggguucgagaucaaggacaagaagugcgacgugcccugcaucggcaucgagauggugcacgacggcgggaaggagacguggcacuccgcggccaccgccaucuacugccucaugggcagcgggcagcugcugugggacaccgucaccggcguggacauggcccucuga

SEQ ID NO: 91242 - RNA, 1401 nt, Artificial Sequence; identical to SEQ ID NO: 91214
  derived and/or modified sequence opt1 from neuraminidase__InfluenzaB__AHL94705

SEQ ID NO: 91243 - RNA, 1401 nt, Artificial Sequence; identical to SEQ ID NO: 89825
  derived and/or modified sequence opt1 from neuraminidase__InfluenzaB__AHL94716

SEQ ID NO: 91244 - RNA, 1401 nt, Artificial Sequence
  derived and/or modified sequence opt1 from neuraminidase__InfluenzaB__AHL94727
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacaccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgccccgcucaucauccgggagcccuucaucgcgugcggccccaaggagugcaagcacuucgcccugacccacuacgccgcccagcccggcggguacuacaacggcacgcgcggggaccggaacaagcugcgccaccucaucagcgugaagcugggcaagaucccgaccguggagaacuccaucuuccacauggcggccuggagcggguccgccugccacgacggcaaggaguggaccuacaucggcgucgacgggcccgacaacaacgcccugcucaagaucaaguacggcgaggccuacaccgacacguaccacagcuacgcgaacaacauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcggauccagcacacggaggagugcacgugcggcuucgccagcaacaagaccaucgagugcgccugccgcgacaacuccuacaccgcgaagcggcccuucgugaagcugaacgucgagaccgacaccgccgagauccgccugaugugcaccaagaccuaccucgacacgccgcggcccgaggacgggagcaucaccggccccugcgaguccaacggcgggaagggcagcgggggcaucaagggcggguucgugcaccagcgcauggccuccaagaucggccggugguacagccgcaccauguccaagaccgagcggaaggggaugggccuguacgugaaguacaacggggaccccugggccgacagcgacgcccuggucuucuccggcgugauggugagcauggaggagccggggugguacuccuucggcuucgagaucaaggacaagaagugcgacguccccugcaucggcaucgagauggugcacgacgggggcaaggagacguggcacagcgcggccaccgccaucuacugccucaugggguccggccagcugcugugggacaccgugaccggcgucaacaugacgcucuga

SEQ ID NO: 91245 - RNA, 1401 nt, Artificial Sequence; identical to SEQ ID NO: 89825
  derived and/or modified sequence opt1 from neuraminidase__InfluenzaB__AHL94738

SEQ ID NO: 91246 - RNA, 1401 nt, Artificial Sequence
  derived and/or modified sequence opt1 from neuraminidase__InfluenzaB__AHL94749
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcguggagaugguccacgacggcgggaaggagaccuggcacuccgccgccacggccaucuacugccucaugggcagcgggcagcugcugugggacaccgugaccggcguggacauggcccucuga

SEQ ID NO: 91247 - RNA, 1401 nt, Artificial Sequence
  derived and/or modified sequence opt1 from neuraminidase__InfluenzaB__AHL94760
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaucaaggggaacuccgcgccccucaucauccgcgagccguucaucgccugcggccccaccgagugcaagcacuucgcccugacgcacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcgcacccaggagagcgccugcaacugcaucggcggggacugcuaccugaugaucaccgacggccccgccagcggcguguccgagugccgguuccucaagauccgcgaggggcggaucaucaaggagaucuuccccacgggccgcgugaagcacaccgaggagugcacgugcggguucgcgagcaacaagaccaucgagugcgccugccgggacaaccgcuacaccgccaagcggcccuucgucaagcugaacguggagaccgacaccgccgagauccgccugaugugcaccgagacguaccucgacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccuguacgucaaguacgacggggaccccuggaccgacuccgaggcgcuggcccucagcggcgugaugguguccauggaggagccggggugguacagcuucggcuucgagaucaaggacaagaagugcgacauccccugcaucgggaucgagaugguccacgacggcggcaagaccaccuggcacuccgccgccacggccaucuacugccugauggggagcggccagcugcucugggacaccgugaccgggguggacauggcgcuguga

SEQ ID NO: 91248 - RNA, 1401 nt, Artificial Sequence; identical to SEQ ID NO: 91214
  derived and/or modified sequence opt1 from neuraminidase__InfluenzaB__AHL94770

SEQ ID NO: 91249 - RNA, 1401 nt, Artificial Sequence; identical to SEQ ID NO: 91212
  derived and/or modified sequence opt1 from neuraminidase__InfluenzaB__AHL94781

SEQ ID NO: 91250 - RNA, 1401 nt, Artificial Sequence; identical to SEQ ID NO: 91210
  derived and/or modified sequence opt1 from neuraminidase__InfluenzaB__AHL94791

SEQ ID NO: 91251 - RNA, 1401 nt, Artificial Sequence; identical to SEQ ID NO: 91241
  derived and/or modified sequence opt1 from neuraminidase__InfluenzaB__AHL94801

SEQ ID NO: 91252 - RNA, 1401 nt, Artificial Sequence; identical to SEQ ID NO: 91210
  derived and/or modified sequence opt1 from neuraminidase__InfluenzaB__AHL94812

SEQ ID NO: 91253 - RNA, 1401 nt, Artificial Sequence; identical to SEQ ID NO: 91210
  derived and/or modified sequence opt1 from neuraminidase__InfluenzaB__AHL94821

SEQ ID NO: 91254 - RNA, 1401 nt, Artificial Sequence; identical to SEQ ID NO: 91214
  derived and/or modified sequence opt1 from neuraminidase__InfluenzaB__AHL94831

SEQ ID NO: 91255 - RNA, 1401 nt, Artificial Sequence
  derived and/or modified sequence opt1 from neuraminidase__InfluenzaB__AHL94840
augcugcccagcaccauccagacccucacgcuguuccugaccuccggcggggugcuccugagccuguacgucuccgccagccucuccuaccugcuguacagcggcauccuccugaaguucucccgcaccgagaucaccgccccgaucaugccccuggacugcgcgaacgccagcaacgugcaggccgugaaccgguccgccacgaagggggucacccuccugcugcccgagcccgaguggaccuacccgcgccucagcugccccggcuccaccuuccagaaggcccugcugaucagcccccaccgguucggggagacgaagggcaacuccgcgccccucaucauccgcgagccguucaucgccugcggccccaaggagugcaagcacuucgcccugacccacuacgccgcgcagcccgggggcuacuacaacgggacccgggaggaccgcaacaagcugcggcaccucaucagcgugaagcugggcaagauccccaccguggagaacuccaucuuccacauggccgccuggagcggguccgccugccacgacggccgcgaguggacguacaucggcgucgacgggccggacagcaacgcccugcucaagaucaaguacggcgaggcguacaccgacaccuaccacuccuacgccaagaacauccugcggacccaggagagcgccugcaacugcaucgggggcgacugcuaccugaugaucacggacggccccgccagcgggaucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacaccgccgagauccgccugaugugcacggagaccuaccucgacaccccgcggcccaacgacgggagcaucaccggccccugcgaguccaacggcgacaaggggagcggcgggaucaagggcggguucgugcaccagcgcauggccuccaagaucggccggugguacagccgcacgauguccaagaccaagcggaugggcauggggcuguacgugaaguacgacggcgaccccuggaccgacagcgaggcccuggcgcucuccggggucauggugagcauggaggagccgggcugguacuccuucggguucgagaucaaggacaagaagugcgacgugcccugcaucggcaucgagaugguccacgacggcgggaagaccacguggcacagcgccgccaccgccaucuacugccugaugggcuccgggcagcugcucugggacaccgugaccggcgugaacaugacgcuguga

SEQ ID NO: 91256 - RNA, 1401 nt, Artificial Sequence
  derived and/or modified sequence opt1 from neuraminidase__InfluenzaB__AHL94851
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaaccgguacaccgccaagcgccccuucgucaagcugaacguggagaccgacaccgccgagauccggcugaugugcacggagaccuaccucgacaccccgcgccccaacgacggcuccaucaccgggcccugcgagagcgacggcgacaagggcuccgggggcaucaagggcggguucgugcaccagcggaugacgagcaagaucgggcgcugguacucccggaccaugagcaagaccaagcgcaugggcaugggccuguacgucaaguacgacggggaccccuggaccgacuccgaggcccuggcccucagcggcgugaugguguccauggaggagccggggugguacagcuucggcuucgagaucaaggacaagaagugcgacguccccugcaucgggaucgagauggugcacgacggcggcaagacgaccuggcacuccgcggccaccgccaucuacugccugauggggagcggccagcugcucugggacaccgugacgggggucgacauggcccuguga

SEQ ID NO: 91257 - RNA, 1401 nt, Artificial Sequence; identical to SEQ ID NO: 89643
  derived and/or modified sequence opt1 from neuraminidase__InfluenzaB__AHL94862

SEQ ID NO: 91258 - RNA, 1401 nt, Artificial Sequence; identical to SEQ ID NO: 89825
  derived and/or modified sequence opt1 from neuraminidase__InfluenzaB__AHL94873

SEQ ID NO: 91259 - RNA, 1401 nt, Artificial Sequence; identical to SEQ ID NO: 91129
  derived and/or modified sequence opt1 from neuraminidase__InfluenzaB__AHL94884

SEQ ID NO: 91260 - RNA, 1401 nt, Artificial Sequence; identical to SEQ ID NO: 89969
  derived and/or modified sequence opt1 from neuraminidase__InfluenzaB__AHL94893

SEQ ID NO: 91261 - RNA, 1401 nt, Artificial Sequence; identical to SEQ ID NO: 89969
  derived and/or modified sequence opt1 from neuraminidase__InfluenzaB__AHL94904

SEQ ID NO: 91262 - RNA, 1401 nt, Artificial Sequence
  derived and/or modified sequence opt1 from neuraminidase__InfluenzaB__AHL94915
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacguccagguggugaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgccccgcucaucauccgggagcccuucaucgcgugcggccccaacgagugcaagcacuucgcccugacccacuacgccgcccagcccggcggguacuacaacggcacccgcggggaccggaacaagcugcgccaccucaucagcgugaagcugggcaagaucccgacggucgagaacuccaucuuccacauggcggccuggagcggguccgccugccacgacggcaaggaguggaccuacaucggcguggacgggcccgacaacaacgcccugcucaaggugaaguacggcgaggccuacaccgacaccuaccacagcuacgcgaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgccugccgcgacaacuccuacaccgcgaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggccuucuccggggucauggugagcaugaaggagccgggcugguacuccuucggguucgagaucaaggacaagaagugcgacgugcccugcaucggcaucgagaugguccacgacggcgggaaggagaccuggcacagcgcggccacggccaucuacugccucaugggcuccgggcagcugcugugggacaccgugaccggcguggacauggcccucuga

SEQ ID NO: 91263 - RNA, 1401 nt, Artificial Sequence; identical to SEQ ID NO: 91129
  derived and/or modified sequence opt1 from neuraminidase__InfluenzaB__AHL94926

SEQ ID NO: 91264 - RNA, 1401 nt, Artificial Sequence
  derived and/or modified sequence opt1 from neuraminidase__InfluenzaB__AHL94937
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgcugccccucgacugcgcgaacgccagcaacgugcaggccgugaaccgcuccgccaccaagggcgucacccugcugcuccccgagccggaguggaccuacccccggcugagcugccccggguccacguuccagaaggcccugcucaucagcccccaccgcuucggcgagaccaaggggaacuccgcgccgcugaucauccgggagcccuucaucgccugcggccccaacgagugcaagcacuucgcccugacccacuacgccgcgcagcccggcggguacuacaacggcacccgcggggaccggaacaagcuccgccaccugaucagcgugaagcugggcaagaucccgacgguggagaacuccaucuuccacauggccgccuggagcggguccgccugccacgacggcaaggaguggaccuacaucggcgucgacgggcccgacaacaacgcccuccugaaggugaaguacggcgaggcguacaccgacaccuaccacagcuacgccaacaagauccugcggacgcaggaguccgccugcaacugcaucgggggcaacugcuaccucaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccucaugugcaccgacaccuaccuggacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccucgcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccugaugggcuccgggcagcugcucugggacaccgucaccggcguggacauggcccuguga

SEQ ID NO: 91265 - RNA, 1401 nt, Artificial Sequence; identical to SEQ ID NO: 91148
  derived and/or modified sequence opt1 from neuraminidase__InfluenzaB__AHL94948

SEQ ID NO: 91266 - RNA, 1401 nt, Artificial Sequence; identical to SEQ ID NO: 89964
  derived and/or modified sequence opt1 from neuraminidase__InfluenzaB__AHL94959

SEQ ID NO: 91267 - RNA, 1401 nt, Artificial Sequence; identical to SEQ ID NO: 89964
  derived and/or modified sequence opt1 from neuraminidase__InfluenzaB__AHL94969

SEQ ID NO: 91268 - RNA, 1401 nt, Artificial Sequence; identical to SEQ ID NO: 89964
  derived and/or modified sequence opt1 from neuraminidase__InfluenzaB__AHL94978

SEQ ID NO: 91269 - RNA, 1401 nt, Artificial Sequence
  derived and/or modified sequence opt1 from neuraminidase__InfluenzaB__AHM00990
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccacuccgccgccaagggcgucacccuccugcugcccgagcccgaguggaccuacccgcgccucagcugccccggguccaccuuccagaaggcccugcugaucagcccccaccgguucggcgagaucaaggggaacuccgcgccccucaucauccgcgagccguucaucgccugcggccccacggagugcaagcacuucgcccugacccacuacgccgcgcagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcgcacccaggagagcgccugcaacugcaucggcggggacugcuaccugaugaucacggacggccccgccagcggcguguccgagugccgguuccucaagauccgcgaggggcggaucaucaaggagaucuuccccaccggccgcgugaagcacaccgaggagugcacgugcggguucgccagcaacaagaccaucgagugcgcgugccgggacaaccgcuacaccgccaagcggcccuucgucaagcugaacguggagaccgacaccgccgagauccgccugaugugcacggagaccuaccucgacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcaugggccuguacgucaaguacgacggggaccccuggaccgacuccgaggcccuggcgcucagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccugauggggagcggccagcugcucugggacaccgugaccggggucgacauggcccuguga

SEQ ID NO: 91270 - RNA, 1401 nt, Artificial Sequence; identical to SEQ ID NO: 91214
  derived and/or modified sequence opt1 from neuraminidase__InfluenzaB__AHM01001

SEQ ID NO: 91271 - RNA, 1401 nt, Artificial Sequence
  derived and/or modified sequence opt1 from neuraminidase__InfluenzaB__AHM01012
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccuggaccgacuccgacgcccuggccuucagcggggugauggucuccaugaaggagccgggcugguacagcuucggguucgagaucaaggacaagaagugcgacgugcccugcaucggcaucgagauggugcacgacggcgggaaggagacguggcacuccgcggccaccgccaucuacugccucaugggcagcgggcagcugcugugggacaccgucaccggcguggacauggcccucuga

SEQ ID NO: 91272 - RNA, 1401 nt, Artificial Sequence; identical to SEQ ID NO: 91214
  derived and/or modified sequence opt1 from neuraminidase__InfluenzaB__AHM01023

SEQ ID NO: 91273 - RNA, 1401 nt, Artificial Sequence; identical to SEQ ID NO: 91214
  derived and/or modified sequence opt1 from neuraminidase__InfluenzaB__AHM01034

SEQ ID NO: 91274 - RNA, 1401 nt, Artificial Sequence
  derived and/or modified sequence opt1 from neuraminidase__InfluenzaB__AHM01045
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccgggguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaaggugaaguacggggaggcguacaccgacaccuaccacagcuacgccaacaagauccugcggacgcaggaguccgccugcaacugcaucggcggcaacugcuaccugaugaucaccgacgggagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggcuccaucacgggccccugcgagagcgacggggacaagggcuccgggggcaucaagggcggguucguccaccagcggaugaaguccaagaucggccgcugguacagccggaccaugagcaagaccgagcgcauggggaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucgccggcguggacauggcgcucuga

SEQ ID NO: 91275 - RNA, 1401 nt, Artificial Sequence
  derived and/or modified sequence opt1 from neuraminidase__InfluenzaB__AHM01056
augcugcccagcaccacccagacgcucacccuguuccugaccuccggcggggugcuccugagccuguacgucuccgccagccucuccuaccugcuguacagcgacauccuccugaaguucuccccgaccgagaucacggcccccaccaugccccuggacugcgcgaacgccagcaacgugcaggccgugaaccgcuccgccaccaagggcgucacccuccugcugcccgagccggaguggacguacccccggcucagcugccccggguccaccuuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacgcgcggggaccggaacaagcugcgccaccucaucagcgugaagcugggcaagaucccgaccguggagaacuccaucuuccacauggccgccuggagcggguccgccugccacgacggcaaggaguggaccuacaucggcgucgacgggcccgacaacaacgcccugcucaaggugaaguacggcgaggcguacaccgacacguaccacagcuacgccaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacacggaggagugcacgugcggcuucgccagcaacaagaccaucgagugcgcgugccgcgacaaccgguacaccgccaagcgccccuucgugaagcugaacguggagaccgacaccgccgagauccggcugaugugcaccgacaccuaccucgacacgccgcgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccugguguucagcggggucaugguguccaugaaggagccgggcugguacagcuucggguucgagaucaaggacaagaagugcgacgugcccugcaucggcaucgagaugguccacgacggcgggaaggagacguggcacuccgcggccaccgccaucuacugccucaugggcagcgggcagcugcugugggacaccgugaccggcguggacauggcccucuga

SEQ ID NO: 91276 - RNA, 1401 nt, Artificial Sequence; identical to SEQ ID NO: 91214
  derived and/or modified sequence opt1 from neuraminidase__InfluenzaB__AHM01067

SEQ ID NO: 91277 - RNA, 1401 nt, Artificial Sequence; identical to SEQ ID NO: 91183
  derived and/or modified sequence opt1 from neuraminidase__InfluenzaB__AHM01078

SEQ ID NO: 91278 - RNA, 1401 nt, Artificial Sequence
  derived and/or modified sequence opt1 from neuraminidase__InfluenzaB__AHM01089
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccgccaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaaccgguacaccgccaagcgccccuucgugaagcugaacguggagaccgacaccgccgagauccggcugaugugcacggacaccuaccucgacaccccgcgccccaacgacggguccaucaccggccccugcgagagcgacggcgacaagggguccggcgggaucaagggcggguucguccaccagcggaugaaguccaagaucggccgcugguacagccggacgaugagcaagaccgagcgcaugggcauggggcuguacgugaaguacgacggcgaccccugggccgacuccgacgcgcuggccuucagcggggugauggucuccaugaaggagccgggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcgcucuga

SEQ ID NO: 91279 - RNA, 1401 nt, Artificial Sequence; identical to SEQ ID NO: 91183
  derived and/or modified sequence opt1 from neuraminidase__InfluenzaB__AHM01100

SEQ ID NO: 91280 - RNA, 1401 nt, Artificial Sequence; identical to SEQ ID NO: 91214
  derived and/or modified sequence opt1 from neuraminidase__InfluenzaB__AHM01111

SEQ ID NO: 91281 - RNA, 1401 nt, Artificial Sequence
  derived and/or modified sequence opt1 from neuraminidase__InfluenzaB__AHM01122
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaagcuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacaccgccgagauccggcugaugugcacggacaccuaccucgacaccccgcgccccaacgacggguccaucaccggccccugcgagagcgacggcgacaagggguccggcgggaucaagggcggguucguccaccagcggaugaaguccaagaucggccgcugguacagccggacgaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcccucuga

SEQ ID NO: 91282 - RNA, 1401 nt, Artificial Sequence; identical to SEQ ID NO: 91214
  derived and/or modified sequence opt1 from neuraminidase__InfluenzaB__AHM01133

SEQ ID NO: 91283 - RNA, 1401 nt, Artificial Sequence
  derived and/or modified sequence opt1 from neuraminidase__InfluenzaB__AHM01144
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccgccaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggaucuccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaaccgguacaccgccaagcgccccuucgucaagcugaacguggagaccgacaccgccgagauccggcugaugugcacggacaccuaccucgacaccccgcgccccaacgacggguccaucaccggccccugcgagagcgacggcgacaagggguccggcgggaucaagggcggguucgugcaccagcggaugaaguccaagaucggccgcugguacagccggacgaugagcaagaccgagcgcaugggcauggggcuguacgucaaguacgacggcgaccccugggccgacuccgacgcgcuggccuucagcggggugaugguguccaugaaggagccgggcugguacagcuucggguucgagaucaaggacaagaagugcgacguccccugcaucggcaucgagauggugcacgacggcgggaaggagaccuggcacuccgccgccaccgccaucuacugccucaugggcagcgggcagcugcugugggacacggugaccggcgucgacauggcgcucuga

SEQ ID NO: 91284 - RNA, 1401 nt, Artificial Sequence; identical to SEQ ID NO: 91214
  derived and/or modified sequence opt1 from neuraminidase__InfluenzaB__AHM01166

SEQ ID NO: 91285 - RNA, 1401 nt, Artificial Sequence
  derived and/or modified sequence opt1 from neuraminidase__InfluenzaB__AHM01188
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccacuccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaaccgcuacaccgccaagcggcccuucgugaagcugaacguggagaccgacacggccgagauccgccugaugugcaccgacaccuaccucgacaccccgcggcccaacgacggguccaucacgggccccugcgagagcgacggcgacaagggguccggcgggaucaagggcggguucguccaccagcgcaugaaguccaagaucggccggugguacagccgcaccaugagcaagaccgagcggaugggcauggggcuguacgugaaguacgacggcgaccccugggccgacuccgacgcccugguguucagcggggucaugguguccaugaaggagccgggcugguacagcuucggguucgagaucaaggacaagaagugcgacgugcccugcaucggcaucgagaugguccacgacggcgggaaggagaccuggcacuccgcggccacggccaucuacugccucaugggcagcgggcagcugcugugggacaccgugaccggcguggacauggcccucuga

SEQ ID NO: 91286 - RNA, 1401 nt, Artificial Sequence; identical to SEQ ID NO: 91278
  derived and/or modified sequence opt1 from neuraminidase__InfluenzaB__AHM01199

SEQ ID NO: 91287 - RNA, 1401 nt, Artificial Sequence
  derived and/or modified sequence opt1 from neuraminidase__InfluenzaB__AHM01210
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccgggguggaccuacccccggcucagcugccccggcuccacguuccagaaggcccugcugaucagcccccaccgcuucggggaggcgaagggcaacuccgccccgcucaucauccgggagcccuucaucgccugcggccccaacgagugcaagcacuucgcccugacccacuacgcggcccagcccgggggcuacuacaacgggacccgcggcgaccggaacaagcugcgccaccucaucagcgugaagcuggggaagaucccgaccguggagaacuccaucuuccacauggccgccuggagcggcuccgccugccacgacggcaaggaguggacguacaucggggucgacggccccgacaacaacgcgcugcucaaggugaaguacggggaggccuacaccgacaccuaccacagcuacgccaacaagauccugcggacccaggaguccgccugcaacugcaucggcggcaacugcuaccugaugaucacggacgggagcgccagcggcguguccgagugccgcuuccucaagauccgggaggggcgcaucaucaaggagaucuuccccaccggccgggucaagcacaccgaggagugcacgugcggguucgcgagcaacaagaccaucgagugcgccugccgcgacaaccgguacaccgccaagcgccccuucgugaagcugaacguggagaccgacaccgccgagauccggcugaugugcacggacaccuaccucgacaccccgcgccccaacgacggcuccaucaccggccccugcgagagcgacggggacaagggcuccgggggcaucaagggcggguucguccaccagcggaugaaguccaagaucggccgcugguacagccggacgaugagcaagaccgagcgcauggggaugggccuguacgugaaguacgacggggaccccugggccgacuccgacgcgcuggccuucagcggcgugauggucuccaugaaggagccggggugguacagcuucggcuucgagaucaaggacaagaagugcgacgugcccugcaucggcaucgagauggugcacgacgggggcaaggagaccuggcacuccgccgccaccgccaucuacugccucauggggagcggccagcugcugugggacacggucgcgggcguggacauggcccucuga

SEQ ID NO: 91288 - RNA, 1401 nt, Artificial Sequence
  derived and/or modified sequence opt1 from neuraminidase__InfluenzaB__AHM01221
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacuuccaggccgugaaccgcuccgccaccaagggcgugaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgucaagcucggcaagaucccgacgguggagaacuccaucuuccacauggccgccuggagcggguccgccugccacgacggcaaggaguggaccuacaucggcguggacgggcccgacaacaacgcccugcugaaggucaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaaccgguacaccgccaagcgccccuucgucaagcucaacguggagaccgacacggccgagauccggcugaugugcaccgacaccuaccuggacaccccgcgccccaacgacggguccaucacgggccccugcgagagcgacggcgacaagggguccggcgggaucaagggcggguucgugcaccagcggaugaaguccaagaucggccgcugguacagccggaccaugagcaagaccgagcgcaugggcauggggcucuacgucaaguacgacggcgaccccugggccgacuccgacgcccuggcguucagcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91289 - RNA, 1401 nt, Artificial Sequence; identical to SEQ ID NO: 91183
  derived and/or modified sequence opt1 from neuraminidase__InfluenzaB__AHM01232

SEQ ID NO: 91290 - RNA, 1401 nt, Artificial Sequence; identical to SEQ ID NO: 91214
  derived and/or modified sequence opt1 from neuraminidase__InfluenzaB__AHM01243

SEQ ID NO: 91291 - RNA, 1401 nt, Artificial Sequence
  derived and/or modified sequence opt1 from neuraminidase__InfluenzaB__AHM01254
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccugguguucagcggggucaugguguccaugaaggagccgggcugguacagcuucggguucgagaucaaggacaagaagugcgacgugcccugcaucggcaucgagaugguccacgacggcgggaaggagaccuggcacuccgcggccacggccaucuacugccucaugggcagcgggcagcugcugugggacaccgugaccggcguggacauggcccucuga

SEQ ID NO: 91292 - RNA, 1401 nt, Artificial Sequence
  derived and/or modified sequence opt1 from neuraminidase__InfluenzaB__AHM01265
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcggcugcugugggacaccgucaccggcguggacauggcccucuga

SEQ ID NO: 91293 - RNA, 1401 nt, Artificial Sequence
  derived and/or modified sequence opt1 from neuraminidase__InfluenzaB__AHM01276
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaaccgguacaccgccaagcgccccuucgucaagcugaacguggagaccgacaccgccgagauccggcugaugugcacggagaccuaccucgacaccccgcgccccaacgacggcuccaucaccgggcccugcgagagcgacggcgacaagggcuccgggggcaucaagggcggguucgugcaccagcggauggccagcaagaucgggcgcugguacucccggacgaugagcaagaccaagcgcaugggcaugggccuguacgucaaguacgacggggaccccuggaccgacuccgaggcccuggcgcucagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccugauggggagcggccagcugcucugggacaccgugaccggggucgacauggcccuguga

SEQ ID NO: 91294 - RNA, 1401 nt, Artificial Sequence; identical to SEQ ID NO: 91278
  derived and/or modified sequence opt1 from neuraminidase__InfluenzaB__AHM01287

SEQ ID NO: 91295 - RNA, 1401 nt, Artificial Sequence; identical to SEQ ID NO: 91278
  derived and/or modified sequence opt1 from neuraminidase__InfluenzaB__AHM01298

SEQ ID NO: 91296 - RNA, 1401 nt, Artificial Sequence; identical to SEQ ID NO: 91293
  derived and/or modified sequence opt1 from neuraminidase__InfluenzaB__AHM01309

SEQ ID NO: 91297 - RNA, 1401 nt, Artificial Sequence; identical to SEQ ID NO: 91214
  derived and/or modified sequence opt1 from neuraminidase__InfluenzaB__AHM01320

SEQ ID NO: 91298 - RNA, 1401 nt, Artificial Sequence; identical to SEQ ID NO: 91278
  derived and/or modified sequence opt1 from neuraminidase__InfluenzaB__AHM01331

SEQ ID NO: 91299 - RNA, 1401 nt, Artificial Sequence; identical to SEQ ID NO: 91214
  derived and/or modified sequence opt1 from neuraminidase__InfluenzaB__AHM01342

SEQ ID NO: 91300 - RNA, 1401 nt, Artificial Sequence
  derived and/or modified sequence opt1 from neuraminidase__InfluenzaB__AHM01353
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccgggguggaccuacccccggcucagcugccccggcuccacguuccagaaggcccugcugaucagcccccaccgcuucggggagaccaagggcaacuccgcgccgcucaucauccgggagcccuucaucgccugcggccccaacgagugcaagcacuucgcccugacccacuacgccgcgcagcccgggggcuacuacaacgggacccgcggcgaccggaacaagcugcgccaccucaucagcgugaagcuggggaagaucccgacgguggagaacuccaucuuccacauggccgccuggagcggcuccgccugccacgacggcaaggaguggaccuacaucggggucgacggccccgacaacaacgcccugcucaaggugaaguacggggaggcguacaccgacaccuaccacagcuacgccaacaagauccugcggacgcaggaguccgccugcaacugcaucggcggcaacugcuaccugaugaucaccgacgggagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggcuccaucacgggccccugcgagagcgacggggacaagggcuccgggggcaucaagggcggguucguccaccagcggaugaaguccaagaucggccgcugguacagccggaccaugagcaagaccgagcgcauggggaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucaccggcguggacauggcccucuga

SEQ ID NO: 91301 - RNA, 1401 nt, Artificial Sequence
  derived and/or modified sequence opt1 from neuraminidase__InfluenzaB__AHM01364
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91302 - RNA, 1401 nt, Artificial Sequence; identical to SEQ ID NO: 91293
  derived and/or modified sequence opt1 from neuraminidase__InfluenzaB__AHM01375

SEQ ID NO: 91303 - RNA, 1401 nt, Artificial Sequence; identical to SEQ ID NO: 91293
  derived and/or modified sequence opt1 from neuraminidase__InfluenzaB__AHM01386

SEQ ID NO: 91304 - RNA, 1401 nt, Artificial Sequence; identical to SEQ ID NO: 91214
  derived and/or modified sequence opt1 from neuraminidase__InfluenzaB__AHM01397

SEQ ID NO: 91305 - RNA, 1401 nt, Artificial Sequence; identical to SEQ ID NO: 91214
  derived and/or modified sequence opt1 from neuraminidase__InfluenzaB__AHM01408

SEQ ID NO: 91306 - RNA, 1401 nt, Artificial Sequence; identical to SEQ ID NO: 91214
  derived and/or modified sequence opt1 from neuraminidase__InfluenzaB__AHM01419

SEQ ID NO: 91307 - RNA, 1401 nt, Artificial Sequence
  derived and/or modified sequence opt1 from neuraminidase__InfluenzaB__AHM01430
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcggcugcugugggacaccgccaccggcgucgacauggcgcucuga

SEQ ID NO: 91308 - RNA, 1401 nt, Artificial Sequence
  derived and/or modified sequence opt1 from neuraminidase__InfluenzaB__AHM01441
augcugcccagcaccauccagacccucacgcuguuccugaccuccggcggggugcuccugagccuguacgucuccgccagccucuccuaccugcuguacagcgacauccuccugaaguucucccagaccgagaucaccgccccgacgaugccccuggacugcgcgaacgccagcaacgugcaggccgugaaccgcuccgccgccaagggcgucacccuccugcugcccgagcccgaguggaccuacccgcggcucagcugccccggguccaccuuccagaaggcgcugcugaucagcccccaccgcuucggcgagaucaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaaccgguacaccgccaagcgccccuucgucaagcugaacguggagaccgacaccgccgagauccggcugaugugcacggagaccuaccucgacaccccgcgccccaacgacggcuccaucaccgggcccugcgagagcgacggcgacaagggcuccgggggcaucaagggcggguucgugcaccagcggauggccagcaagaucgggcgcugguacucccggacgaugagcaagaccaagcgcaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccugauggggagcggccagcugcucugggacaccgugaccggggucgacauggcgcuguga

SEQ ID NO: 91309 - RNA, 1401 nt, Artificial Sequence; identical to SEQ ID NO: 91214
  derived and/or modified sequence opt1 from neuraminidase__InfluenzaB__AHM01463

SEQ ID NO: 91310 - RNA, 1401 nt, Artificial Sequence
  derived and/or modified sequence opt1 from neuraminidase__InfluenzaB__AHM01474
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcaucaacgcgagcaacgugcaggccgugaaccgcuccgccgccaagggcgucacgcuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccaccgagugcaagcacuucgcccugacgcacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggaccuacaucggcgucgacggcccggacagcaacgcccugcucaagaucaaguacggggaggcguacacggacaccuaccacuccuacgccaagaacauccugcggacccaggagagcgccugcaacugcaucggcggggacugcuaccugaugaucaccgacggccccgccagcggcguguccgagugccgcuuccucaagauccgggaggggcgcaucaucaaggagaucuuccccacgggccgggugaagcacaccgaggagugcacgugcggguucgccagcaacaagaccaucgagugcgcgugccgcgacaaccgguacaccgccaagcgccccuucgucaagcugaacguggagaccgacaccgccgagauccggcugaugugcaccgagacguaccucgacaccccgcgccccaacgacggcuccaucaccgggcccugcgagagcgacggcgacaagggcuccgggggcaucaagggcggguucgugcaccagcggauggccagcaagaucgggcgcugguacucccggaccaugagcaagacgaagcgcaugggcaugggccuguacgucaaguacgacggggaccccuggaccgacuccgaggcccuggcgcucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcccuguga

SEQ ID NO: 91311 - RNA, 1401 nt, Artificial Sequence
  derived and/or modified sequence opt1 from neuraminidase__InfluenzaB__AHM01485
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccaucaugccccuggacugcacgaacgcgagcaacgugcaggccgugaaccgcuccgccgccaagggcgucacccuccugcugcccgagccggaguggaccuacccccggcucagcugccccggguccaccuuccagaaggcccugcugaucagcccccaccgcuucggcgagaucaaggggaacuccgcgccgcucaucauccgggagcccuucaucgccugcggccccacggagugcaagcacuucgcccugacccacuacgccgcgcagcccggcggguacuacaacggcacccgcgaggaccggaacaagcugcgccaccucaucagcgugaagcuggggaagaucccgaccguggagaacuccaucuuccacauggccgccuggagcggcuccgccugccacgacgggaaggaguggacguacaucggcgucgacggccccgacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgccagcaacaagaccaucgagugcgcgugccgcgacaaccgguacaccgccaagcgcccguucgucaagcugaacguggagaccgacaccgccgagauccggcugaugugcacggagaccuaccucgacacgccccgccccaacgacggcuccaucaccgggcccugcgagagcgacggcgacaagggcuccgggggcaucaagggcggguucgugcaccagcggauggccagcaagaucgggcgcugguacucccggaccaugagcaagaccaagcgcaugggcaugggccuguacgucaaguacgacggggacccguggaccgacuccgaggcccuggcgcucagcggcgugaugguguccauggaggagcccgggugguacagcuucggcuucgagaucaaggacaagaagugcgacguccccugcaucgggaucgagauggugcacgacggcggcaagaccacguggcacuccgccgccaccgccaucuacugccugauggggagcggccagcugcucugggacaccgugaccggggucgacauggcccuguga

SEQ ID NO: 91312 - RNA, 1401 nt, Artificial Sequence; identical to SEQ ID NO: 91293
  derived and/or modified sequence opt1 from neuraminidase__InfluenzaB__AHM01496

SEQ ID NO: 91313 - RNA, 1401 nt, Artificial Sequence
  derived and/or modified sequence opt1 from neuraminidase__InfluenzaB__AHM01507
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaucaaggggaacuccgcgccccucaucgugcgggagccguucaucgccugcggccccaccgagugcaagcacuucgcccugacgcacuacgccgcccagcccggcggguacuacaacggcacccgcgaggaccggaacaagcugcgccaccucaucagcgugaagcuggggaagauccccaccgucgagaacuccaucuuccacauggccgccuggagcggcuccgccugccacgacgggaaggaguggaccuacaucggcguggacggcccggacagcaacgcgcugcucaagaucaaguacggggaggccuacacggacaccuaccacuccuacgccaagaacauccugcggacccaggagagcgccugcaacugcaucggcggggacugcuaccugaugaucaccgacggccccgccagcggcguguccgagugccgcuuccucaagauccgggaggggcgcaucaucaaggagaucuuccccacgggccgggucaagcacaccgaggagugcacgugcggguucgcgagcaacaagaccaucgagugcgccugccgcgacaaccgguacaccgccaagcgccccuucgugaagcugaacguggagaccgacaccgccgagauccggcugaugugcaccgagacguaccucgacaccccgcgccccaacgacggcuccaucaccgggcccugcgagagcgacggcgacaagggcuccgggggcaucaagggcggguucguccaccagcggauggccagcaagaucgggcgcugguacucccggaccaugagcaagacgaagcgcaugggcaugggccuguacgugaaguacgacggggaccccuggaccgacuccgaggcgcuggcccucagcggcgugauggucuccaucgaggagccggggugguacagcuucggcuucgagaucaaggacaagaagugcgacgugcccugcaucgggaucgagauggugcacgacggcggcaagaccaccuggcacuccgccgccacggccaucuacugccugauggggagcggccagcugcucugggacaccgucaccgggguggacauggcgcuguga

SEQ ID NO: 91314 - RNA, 1401 nt, Artificial Sequence; identical to SEQ ID NO: 91293
  derived and/or modified sequence opt1 from neuraminidase__InfluenzaB__AHM01518

SEQ ID NO: 91315 - RNA, 1401 nt, Artificial Sequence
  derived and/or modified sequence opt1 from neuraminidase__InfluenzaB__AHM01529
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagauccugcccaccggccgggugaagcacaccgaggagugcacgugcggguucgccagcaacaagaccaucgagugcgcgugccgcgacaaccgguacaccgccaagcgccccuucgucaagcugaacguggagaccgacaccgccgagauccggcucaugugcacggagaccuaccuggacaccccgcgccccaacgacggcuccaucaccgggcccugcgagagcgacggcgacaagggcuccgggggcaucaagggcggguucgugcaccagcggauggccagcaagaucgggcgcugguacucccggacgaugagcaagaccaagcgcaugggcaugggccuguacgucaaguacgacggggaccccuggaccgacuccgaggcccucgcgcugagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccugauggggagcggccagcuccugugggacaccgugaccggggucgacauggcccuguga

SEQ ID NO: 91316 - RNA, 1401 nt, Artificial Sequence; identical to SEQ ID NO: 91183
  derived and/or modified sequence opt1 from neuraminidase__InfluenzaB__AHM01540

SEQ ID NO: 91317 - RNA, 1401 nt, Artificial Sequence; identical to SEQ ID NO: 91293
  derived and/or modified sequence opt1 from neuraminidase__InfluenzaB__AHM01551

SEQ ID NO: 91318 - RNA, 1401 nt, Artificial Sequence; identical to SEQ ID NO: 91293
  derived and/or modified sequence opt1 from neuraminidase__InfluenzaB__AHM01562

SEQ ID NO: 91319 - RNA, 1401 nt, Artificial Sequence; identical to SEQ ID NO: 89800
  derived and/or modified sequence opt1 from neuraminidase__InfluenzaB__AHZ13597

SEQ ID NO: 91320 - RNA, 1404 nt, Artificial Sequence
  derived and/or modified sequence opt1 from neuraminidase__InfluenzaB__AHZ36701
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccggaagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 91321 - RNA, 1404 nt, Artificial Sequence
  derived and/or modified sequence opt1 from neuraminidase__InfluenzaB__AHZ36756
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcugcccgagccggaguggaccuacccccggcucagcugccccggguccaccuuccagaaggcccugcugaucagcccccaccgcuucggcgagacgaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcccugcucaagaucaaguacggcgaggcguacaccgacaccuaccacagcuacgccaacaacauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacaccgccgagauccgccugaugugcacggacaccuaccucgacaccccgcggcccgacgacgggagcaucaccggccccugcgaguccaacggcgacaaggggagcggcgggaucaagggcggguucgugcaccagcgcauggccuccaagaucggccggugguacagccgcacgauguccaagaccgagcggaugggcauggggcuguacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 91322 - RNA, 1401 nt, Artificial Sequence
  derived and/or modified sequence opt1 from neuraminidase__InfluenzaB__AHZ36767
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgcgcccccuggacugcgcgaacgccagcaacgugcaggccgugaaccgguccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaaccgcuacaccgccaagcggcccuucgugaagcugaacguggagaccgacacggccgagauccgccugaugugcaccgacaccuaccucgacaccccgcggcccaacgacggguccaucacgggccccugcgagagcgacggcgacaagggguccggcgggaucaagggcggguucguccaccagcgcaugaaguccaagaucggccggugguacagccgcaccaugagcaagaccgagcggaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91323 - RNA, 1401 nt, Artificial Sequence
  derived and/or modified sequence opt1 from neuraminidase__InfluenzaB__AHZ36778
augcugcccagcaccauccagacccucacgcuguuccugaccuccggcggggugcuccugagccuguacgucuccgccagccucuccuaccugcuguacagcgacauccuccugaaguucccguccaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaagaucaaguacggcgaggcguacaccgacaccuaccacagcuacgccaacaacauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcggauccagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccaagaccuaccucgacaccccgcggcccgaggacgggagcaucacgggccccugcgaguccaacggcgggaagggcagcgggggcaucaagggcggguucgugcaccagcgcauggccuccaagaucggccggugguacagccgcaccauguccaagaccgagcggaaggggaugggccuguacgugaaguacaacggggaccccugggccgacagcgacgcgcuggucuucuccggcgugaugaucagcauggaggagccggggugguacuccuucggcuucgagaucaaggacaagaagugcgacgugcccugcaucggcaucgagaugguccacgacgggggcaaggagaccuggcacagcgccgccacggccaucuacugccucaugggguccggccagcugcugugggacaccgugaccggcgugaacaugacccucuga

SEQ ID NO: 91324 - RNA, 1401 nt, Artificial Sequence
  derived and/or modified sequence opt1 from neuraminidase__InfluenzaB__AHZ36789
augcugcccagcaccauccagacccucacgcuguuccugaccuccggcggggugcuccugagccuguacgucuccgccagccucuccuaccugcuguacagcgacauccuccugaaguucuccccgaccgagaucaccgcccagacgaugccccuggacugcgcgaacgccagcaacgugcaggccgugaaccgcuccgccaccaagggcgucacccuccugccgcccgagcccgaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcucaacguggagaccgacacggccgagauccggcugaugugcaccgacaccuaccuggacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcucuacgugaaguacgacggcgaccccugggccgacuccgacgcccuggcguucagcggggugauggucuccaugaaggagccgggcugguacagcuucggguucgagaugaaggacaagaagugcgacgugcccugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 91325 - RNA, 1401 nt, Artificial Sequence; identical to SEQ ID NO: 91324
  derived and/or modified sequence opt1 from neuraminidase__InfluenzaB__AHZ36800

SEQ ID NO: 91326 - RNA, 1401 nt, Artificial Sequence
  derived and/or modified sequence opt1 from neuraminidase__InfluenzaB__AHZ36811
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcacgaacgcgagcaacgugcaggccgugaaccgcuccgccgccaagggcgucacccuccugcugcccgagcccgaguggaccuacccgcggcucagcugccccggguccaccuuccagaaggcccugcugaucagcccccaccgcuucggcgagaucaaggggaacuccgcgccccucaucauccgggagccguucaucgccugcggccccacggagugcaagcacuucgcccugacccacuacgccgcgcagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcccugcucaagaucaaguacggggaggcguacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucauccgggagaucuuccccaccggccgcgugaagcacaccgaggagugcacgugcggguucgccagcaacaagaccaucgagugcgcgugccgggacaaccgcuacaccgccaagcggcccuucgucaagcugaacguggagaccgacaccgccgagauccgccugaugugcacggagaccuaccucgacaccccgcggcccaacgacggcuccaucaccgggcccugcgagagcgacggcgacaagggcuccgggggcaucaagggcggguucgugcaccagcgcauggccagcaagaucgggcggugguacucccgcacgaugagcaagaccaagcggaugggcaugggccuguacgucaaguacgacggggaccccuggaccgacuccgaggcccuggcgcucagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccugauggggagcggccagcugcucugggacaccgugaccggggucgacauggcccuguga

SEQ ID NO: 91327 - RNA, 1404 nt, Artificial Sequence; identical to SEQ ID NO: 91321
  derived and/or modified sequence opt1 from neuraminidase__InfluenzaB__AHZ36822

SEQ ID NO: 91328 - RNA, 1401 nt, Artificial Sequence
  derived and/or modified sequence opt1 from neuraminidase__InfluenzaB__AHZ36833
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgcgcccccuggacugcgcgaacgccagcaacgugcaggccgugaaccgguccgccaccaagggcgucacccuccugcugcccgagccggaguggaccuacccccgccucagcugccccggguccacguuccagaaggcccugcugaucagcccccaccgguucggcgagaccaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcgcacgcaggaguccgccugcaacugcaucgggggcaacugcuaccugaugaucaccgacggcagcgccagcgggguguccgagugccgguuccucaagguccgcgagggccggaucaucaaggagaucuuccccaccgggcgcgugaagcacaccgaggagugcacgugcggcuucgccagcaacaagaccaucgagugcgcgugccgggacaaccgcuacaccgccaagcggcccuucgugaagcugaacgucgagaccgacacggccgagauccgccugaugugcaccgacaccuaccucgacaccccgcggcccaacgacggguccaucacgggccccugcgagagcgacggcgacaagggguccggcgggaucaagggcggguucgugcaccagcgcaugaaguccaagaucggccggugguacagccgcaccaugagcaagaccgagcggaugggcauggggcuguacgugaaguacgacggcgaccccugggccgacuccgacgcccuggcguucagcggggucaugguguccaugaaggagccgggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcguggacauggcccucuga

SEQ ID NO: 91329 - RNA, 1401 nt, Artificial Sequence
  derived and/or modified sequence opt1 from neuraminidase__InfluenzaB__AHZ36844
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgcgcccccuggacugcgcgaacgccagcaacgugcaggccgugaaccgguccgccaccaaggaggucacccuccugcugcccgagccggaguggaccuacccccgccucagcugccccggcuccacguuccagaaggcccugcugaucagcccccaccgguucggggagaccaagggcaacuccgcgccgcucaucauccgcgagcccuucaucgccugcgggcccaacgagugcaagcacuucgcccugacccacuacgccgcgcagcccggcggcuacuacaacgggacccggggcgaccgcaacaagcugcggcaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaaggugaaguacggggaggcguacaccgacaccuaccacagcuacgccaacaagauccugcgcacgcaggaguccgccugcaacugcaucggcgggaacugcuaccugaugaucaccgacggcagcgccagcggcguguccgagugccgguuccucaagauccgcgaggggcggaucaucaaggagaucuuccccaccggccgcgucaagcacaccgaggagugcacgugcggguucgccagcaacaagaccaucgagugcgcgugccgggacaaccgcuacaccgccaagcggcccuucgugaagcugaacguggagaccgacacggccgagauccgccugaugugcaccgacaccuaccucgacaccccgcggcccaacgacggcuccaucacggggcccugcgagagcgacggcgacaagggcuccgggggcaucaagggcggguucguccaccagcgcaugaaguccaagaucgggcggugguacagccgcaccaugagcaagaccgagcggaugggcaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucgggaucgagauggugcacgacggcggcaaggagaccuggcacuccgccgccacggccaucuacugccucauggggagcggccagcugcugugggacaccgucaccgggguggacauggcccucuga

SEQ ID NO: 91330 - RNA, 1401 nt, Artificial Sequence
  derived and/or modified sequence opt1 from neuraminidase__InfluenzaB__AHZ36855
augcugcccagcaccauccagacccucacgcuguuccugaccuccggcggggugcuccugagccuguacgucuccgccagccucuccuaccugcuguacagcgacauccuccugaaguucuccccgaccgagaucaccgugcagacgaugccccuggacugcgccaacgcgagcaacgugcaggccgucaaccgcuccgccaccaagggcgugacccuccugccgcccgagcccgaguggaccuacccccggcugagcugccccggguccacguuccagaaggcccuccugaucagcccccaccgcuucggcgagaccaaggggaacuccgccccgcugaucauccgggagcccuucaucgcgugcggccccaacgagugcaagcacuucgcccucacccacuacgccgcccagcccggcggguacuacaacggcacccgcggggaccggaacaagcugcgccaccugaucagcgugaagcucggcaagaucccgacggucgagaacuccaucuuccacauggcggccuggagcggguccgccugccacgacggcaaggaguggaccuacaucggcguggacgggcccgacaacaacgcccugcugaaggugaaguacggcgaggccuacaccgacaccuaccacagcuacgcgaacaagauccuccggacgcaggaguccgccugcaacugcaucgggggcaacugcuaccugaugaucaccgacggcagcgccagcggggucuccgagugccgcuuccugaagauccgggagggccgcaucaucaaggagaucuuccccaccgggcgggugaagcacaccgaggagugcacgugcggcuucgccagcaacaagaccaucgagugcgccugccgcgacaaccgguacaccgcgaagcgccccuucgugaagcucaacgucgagaccgacacggccgagauccggcugaugugcaccgacaccuaccuggacaccccgcgccccaacgacggguccaucacgggccccugcgagagcgacggcgacaagggguccggcgggaucaagggcggguucgugcaccagcggaugaaguccaagaucggccgcugguacagccggaccaugagcaagaccgagcgcaugggcauggggcucuacgugaaguacgacggcgaccccugggccgacuccgacgcccuggccuucagcggggucaugguguccaugaaggagccgggcugguacagcuucggguucgagaugaaggacaagaagugcgacgugcccugcaucggcaucgagaugguccacgacggcgggaaggagaccuggcacuccgcggccacggccaucuacugccugaugggcagcgggcagcuccugugggacaccgugaccggcguggacauggcccuguga

SEQ ID NO: 91331 - RNA, 1404 nt, Artificial Sequence; identical to SEQ ID NO: 91321
  derived and/or modified sequence opt1 from neuraminidase__InfluenzaB__AHZ36866

SEQ ID NO: 91332 - RNA, 1401 nt, Artificial Sequence
  derived and/or modified sequence opt1 from neuraminidase__InfluenzaB__AHZ36877
augcugcccagcaccauccagacccucacgcuguuccugaccuccggcggggugcuccugagccuguacgucuccgccagccucuccuaccugcuguacagcgacauccuccugaaguucuccccgcccgagaucaccgcccccaccaugccccuggacugcgcgaacgccagcaacgugcaggccgugaaccgcuccgccacgaagggcgucacccuccugcugccggagcccgaguggaccuacccccggcucagcugccccggguccaccuuccagaaggcccugcugaucagcccgcaccgcuucggcgagacgaaggggaacuccgcgccccucaucauccgggagcccuucaucgccugcggccccaacgagugcaagcacuucgcccugacccacuacgccgcgcagccgggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggacguacaucggcgucgacgggcccgacaacaacgcccugcucaaggugaaguacggcgaggcguacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgcccguucgugaagcugaacguggagaccgacaccgccgagauccggcugaugugcacggacaccuaccucgacacgccccgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgacccgugggccgacuccgacgcccuggcguucagcggggugauggucuccaugaaggagcccggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcccucuga

SEQ ID NO: 91333 - RNA, 1404 nt, Artificial Sequence; identical to SEQ ID NO: 91321
  derived and/or modified sequence opt1 from neuraminidase__InfluenzaB__AHZ36888

SEQ ID NO: 91334 - RNA, 1404 nt, Artificial Sequence; identical to SEQ ID NO: 91321
  derived and/or modified sequence opt1 from neuraminidase__InfluenzaB__AHZ36899

SEQ ID NO: 91335 - RNA, 1404 nt, Artificial Sequence; identical to SEQ ID NO: 91321
  derived and/or modified sequence opt1 from neuraminidase__InfluenzaB__AHZ36910

SEQ ID NO: 91336 - RNA, 1401 nt, Artificial Sequence; identical to SEQ ID NO: 91323
  derived and/or modified sequence opt1 from neuraminidase__InfluenzaB__AHZ36921

SEQ ID NO: 91337 - RNA, 1401 nt, Artificial Sequence
  derived and/or modified sequence opt1 from neuraminidase__InfluenzaB__AHZ36932
augcugcccagcaccauccagacccucacgcuguuccugaccuccggcggggugcuccugagccuguacgucuccgccagccucuccuaccugcuguacagcgacauccuccugaaguucuccccgaccgagaucaccgcccagacgaugccccuggacugcgcgaacgccagcaacgugcaggccgugaaccgcuccgccaccaagggcgucacccuccugccgcccgagcccgaguggaccuacccccggcugagcugccccggguccacguuccagaaggcccuccugaucagcccccaccgcuucggcgagaccaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccauggagugcgcgugccgcgacaaccgguacaccgccaagcgccccuucgugaagcucaacguggagaccgacacggccgagauccggcugaugugcaccgacaccuaccuggacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcucuacgugaaguacgacggcgaccccugggccgacuccgacgcccuggcguucagcggggugauggucuccaugaaggagccgggcugguacagcuucggguucgagaugaaggacaagaagugcgacgugcccugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 91338 - RNA, 1401 nt, Artificial Sequence
  derived and/or modified sequence opt1 from neuraminidase__InfluenzaB__AHZ36943
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcccccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaacgagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgcccguucgugaagcucaacguggagaccgacacggccgagauccggcugaugugcaccgacaccuaccuggacacgccccgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcucuacgugaaguacgacggcgacccgugggccgacuccgacgcccuggcguucagcggggugauggucuccaugaaggagcccggcugguacagcuucggguucgagaugaaggaccggaagugcgacgugcccugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 91339 - RNA, 1404 nt, Artificial Sequence; identical to SEQ ID NO: 91321
  derived and/or modified sequence opt1 from neuraminidase__InfluenzaB__AHZ36954

SEQ ID NO: 91340 - RNA, 1401 nt, Artificial Sequence
  derived and/or modified sequence opt1 from neuraminidase__InfluenzaB__AHZ36965
augcugcccagcaccauccagacccucacgcuguuccugaccuccggcggggugcuccugagccuguacgucuccgccagccucuccuaccugcuguacagcgacauccuccugaaguucuccccgcccgagaucaacgcccccaccaugccccuggacugcgcgaacgccagcaacgugcaggccgugaaccgcuccgccaccaagggcgucacgcuccugcugccggagcccgaguggaccuacccccggcucagcugccccggguccaccuuccagaaggcccugcugaucagcccgcaccgcuucggcgagaccaaggggaacuccgcgccccucaucauccgggagcccuucaucgccugcggccccaacgagugcaagcacuucgcccugacgcacuacgccgcgcagccgggcggguacuacaacggcacccgcggggaccggaacaagcugcgccaccucaucagcgugaagcugggcaagauccccaccguggagaacuccaucuuccacauggccgccuggagcggguccgccugccacgacggcaaggaguggaccuacaucggcgucgacgggcccgacaacaacgcccugcucaaggugaaguacggcgaggcguacacggacaccuaccacagcuacgccaacaagauccugcggacccaggaguccgccugcaacugcaucgggggcaacugcuaccugaugaucaccgacggcagcgccagcgggguguccgagugccgcuuccucaagauccgggagggccgcaucaucaaggagaucuuccccacggggcgggucaagcacaccgaggagugcacgugcggcuucgccagcaacaagaccaucgagugcgcgugccgcgacaaccgguacaccgccaagcgcccguucgugaagcugaacguggagaccgacaccgccgagauccggcugaugugcaccgacacguaccucgacacgccccgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgacccgugggccgacuccgacgcccuggcguucagcggggugauggucuccaugaaggagcccggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacaccgucacgggcguggacauggcccucuga

SEQ ID NO: 91341 - RNA, 1404 nt, Artificial Sequence; identical to SEQ ID NO: 91321
  derived and/or modified sequence opt1 from neuraminidase__InfluenzaB__AHZ36976

SEQ ID NO: 91342 - RNA, 1404 nt, Artificial Sequence; identical to SEQ ID NO: 91321
  derived and/or modified sequence opt1 from neuraminidase__InfluenzaB__AHZ36987

SEQ ID NO: 91343 - RNA, 1401 nt, Artificial Sequence; identical to SEQ ID NO: 91324
  derived and/or modified sequence opt1 from neuraminidase__InfluenzaB__AHZ36998

SEQ ID NO: 91344 - RNA, 1401 nt, Artificial Sequence
  derived and/or modified sequence opt1 from neuraminidase__InfluenzaB__AHZ37009
augcugcccagcaccauccagacccucacgcuguuccugacccucggcggggugcugcugucccucuacgucagcgccucccugagcuaccugcucuacuccgacauccugcugaaguucagcccgaccgagaucaccgcccccacgaugccccucggcugcgcgaacgccuccaacgugcaggccgugaaccgcagcgccaccaagggggucacccugcugcuccccgagccggaguggaccuacccccggcuguccugccccggcagcacguuccagaaggcccugcucaucagcccccaccgcuucggggagaccaagggcaacuccgcgccgcugaucauccgggagcccuucaucgccugcggccccaacgagugcaagcacuucgcccugacccacuacgccgcgcagcccgggggcuacuacaacgggacccgcggcgaccggaacaagcuccgccaccugaucuccgugaagcuggggaagaucccgacgguggagaacagcaucuuccacauggccgccugguccggcagcgccugccacgacggcaaggaguggaccuacaucggggucgacggccccgacaacaacgcccuccugaaggugaaguacggggaggcguacaccgacaccuaccacuccuacgccaacaagauccugcggacgcaggagagcgccugcaacugcaucggcggcaacugcuaccucaugaucaccgacggguccgccagcggcgugagcgagugccgcuuccugaagauccgggaggggcgcaucaucaaggagaucuuccccaccggccgggucaagcacaccgaggagugcacgugcggguucgccuccaacaagaccaucgagugcgcgugccgcgacaaccgguacaccgccaagcgccccuucgugaagcugaacguggaggccgacaccgccgagauccggcucaugugcacggacaccuaccuggacaccccgcgccccaacgacggcagcaucaccggccccugcgaguccgacggggacaagggcagcgggggcaucaagggcggguucguccaccagcggaugaaguccaagaucggccgcugguacagccggacgauguccaagaccgagcgcauggggaugggccuguacgugaaguacgacggggaccccugggccgacagcgacgcgcucgccuucuccggcgugauggucagcaugaaggagccggggugguacuccuucggcuucgagaucaaggacaagaagugcgacgugcccugcaucggcaucgagauggugcacgacgggggcaaggagaccuggcacagcgccgccaccgccaucuacugccugaugggguccggccagcugcucugggacacggucaccggcguggacauggcgcuguga

SEQ ID NO: 91345 - RNA, 1401 nt, Artificial Sequence; identical to SEQ ID NO: 91322
  derived and/or modified sequence opt1 from neuraminidase__InfluenzaB__AHZ37020

SEQ ID NO: 91346 - RNA, 1401 nt, Artificial Sequence; identical to SEQ ID NO: 91324
  derived and/or modified sequence opt1 from neuraminidase__InfluenzaB__AHZ37031

SEQ ID NO: 91347 - RNA, 1401 nt, Artificial Sequence; identical to SEQ ID NO: 91322
  derived and/or modified sequence opt1 from neuraminidase__InfluenzaB__AHZ37042

SEQ ID NO: 91348 - RNA, 1401 nt, Artificial Sequence; identical to SEQ ID NO: 91324
  derived and/or modified sequence opt1 from neuraminidase__InfluenzaB__AHZ37064

SEQ ID NO: 91349 - RNA, 1401 nt, Artificial Sequence; identical to SEQ ID NO: 91322
  derived and/or modified sequence opt1 from neuraminidase__InfluenzaB__AHZ37075

SEQ ID NO: 91350 - RNA, 1401 nt, Artificial Sequence; identical to SEQ ID NO: 91322
  derived and/or modified sequence opt1 from neuraminidase__InfluenzaB__AHZ37086

SEQ ID NO: 91351 - RNA, 1401 nt, Artificial Sequence
  derived and/or modified sequence opt1 from neuraminidase__InfluenzaB__AHZ37097
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcccccggagcccgaguggaccuacccccggcugagcugccccggguccacguuccagaaggcccuccugaucagcccgcaccgcuucggcgagaccaaggggaacuccgcgccccugaucauccgggagcccuucaucgccugcggccccaacgagugcaagcacuucgcccucacccacuacgccgcgcagccgggcggguacuacaacggcacccgcggggaccggaacaagcugcgccaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccggacgcaggaguccgccugcaacugcaucgggggcaacugcuaccugaugaucaccgacggcagcgccagcgggguguccgagugccgcuuccugaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgcccguucgugaagcucaacguggagaccgacacggccgagauccggcugaugugcaccgacaccuaccuggacacgccccgccccaacgacggguccaucaccggccccugcgagagcgacggcgacaagggguccggcgggaucaagggcggguucguccaccagcggaugaaguccaagaucggccgcugguacagccggaccaugagcaagaccgagcgcaugggcauggggcucuacgugaaguacgacggcgacccgugggccgacuccgacgcccuggcguucagcggggugauggucuccaugaaggagcccggcugguacagcuucggguucgagaugaaggacaagaagugcgacgugcccugcaucggcaucgagauggugcacgacggcgggaaggagaccuggcacuccgccgccacggccaucuacugccugaugggcagcgggcagcuccugugggacaccgucaccggcguggacauggcccuguga

SEQ ID NO: 91352 - RNA, 1401 nt, Artificial Sequence; identical to SEQ ID NO: 91322
  derived and/or modified sequence opt1 from neuraminidase__InfluenzaB__AHZ37108

SEQ ID NO: 91353 - RNA, 1401 nt, Artificial Sequence
  derived and/or modified sequence opt1 from neuraminidase__InfluenzaB__AHZ41774
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgguccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggcagcaacgagugccgccacuucgcccucacccacuacgccgcgcagcccggcggguacuacaacggcacccgcggggaccggaacaagcugcggcaccugaucuccgugaagcucggcaagauccccaccguggagaacagcaucuuccacauggccgccugguccgggagcgccugccacgacggcaaggaguggacguacaucggcgucgacgggccggacaacaacgcccugcugaagaucaaguacggcgaggcguacaccgacaccuaccacuccuacgccaacaacauccuccgcacccaggagagcgccugcaacugcaucgggggcaacugcuaccugaugaucacggacggcagcgccuccggggugagcgagugccgguuccugaagauccgcgagggccggaucaucaaggagaucuuccccaccgggcgcgugaagcacaccgaggagugcacgugcggcuucgccuccaacaagaccaucgagugcgcgugccgggacaacagcuacaccgccaagcgccccuucgucaagcucaacguggagaccgacaccgccgagauccggcugaugugcacggacaccuaccuggacacgccccgcccggacgacggguccaucaccggccccugcgagagcaacggcgacaagggguccggcgggaucaagggcggguucgugcaccagcggauggccagcaagaucggccgcugguacucccggaccaugagcaagaccgagcgcaagggcauggggcucuacgucaaguacgacggcgaccccuggaccgacaacgacgcccuggcguuccgcggggugaugguguccaugaaggagcccggcugguacagcuucggguucgagaucaaggacaagaagugcgacgucccgugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91354 - RNA, 1401 nt, Artificial Sequence; identical to SEQ ID NO: 89964
  derived and/or modified sequence opt1 from neuraminidase__InfluenzaB__AHZ41785

SEQ ID NO: 91355 - RNA, 1401 nt, Artificial Sequence; identical to SEQ ID NO: 89964
  derived and/or modified sequence opt1 from neuraminidase__InfluenzaB__AHZ41796

SEQ ID NO: 91356 - RNA, 1401 nt, Artificial Sequence
  derived and/or modified sequence opt1 from neuraminidase__InfluenzaB__AHZ41807
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgcuccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugcaagcacuucgcccucacccacuacgccgcgcagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccggacccaggaguccgccugcaacugcaucgaggggaacugcuaccugaugaucacggacggcagcgccagcggcguguccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacggacaccuaccuggacaccccgcggcccgacgacggcagcaucaccgggcccugcgaguccaacggcgacaagggcagcgggggcaucaagggcggguucgugcaccagcgcauggccuccaagaucgggcggugguacagccgcacgauguccaagaccgagcggaagggcaugggccucuacgucaaguacgacggggaccccuggaccgacagcgacgcccuggcguuccgcggcgugaugguguccaugaaggagccggggugguacagcuucggcuucgagaucaaggacaagaagugcgacguccccugcaucgggaucgagauggugcacgacggcggcaaggagaccuggcacuccgccgccacggccaucuacugccugauggggagcggccagcuccugugggacaccgugaccggggucgacauggcccuguga

SEQ ID NO: 91357 - RNA, 1401 nt, Artificial Sequence
  derived and/or modified sequence opt1 from neuraminidase__InfluenzaB__AHZ41818
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugauggugaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgugaagcugaacgucgagaccgacacggccgagauccgccugaugugcaccgacaccuaccucgacaccccgcggcccgacgacgggagcaucacgggccccugcgaguccaacggcgacaaggggagcggcgggaucaagggcggguucgugcaccagcgcauggaguccaagaucggccggugguacagccgcaccauguccaagaccgagcggaugggcauggggcuguacgugaaguacgacggcgaccccugggccgacagcgacgcccuggucuucuccggggugauggugagcaugaaggagccgggcugguacuccuucggguucgagaucaaggacaagaagugcgacguccccugcaucggcaucgagauggugcacgacggcgggaaggagaccuggcacagcgcggccacggccaucuacugccucaugggcuccgggcagcugcugugggacaccgugaccggcgucaacauggcccucuga

SEQ ID NO: 91358 - RNA, 1401 nt, Artificial Sequence; identical to SEQ ID NO: 89964
  derived and/or modified sequence opt1 from neuraminidase__InfluenzaB__AHZ41829

SEQ ID NO: 91359 - RNA, 1401 nt, Artificial Sequence
  derived and/or modified sequence opt1 from neuraminidase__InfluenzaB__AHZ41840
augcugcccagcaccauccagaugcucacccuguuccugacguccggcggggugcuccugagccuguacgucuccgccagccucuccuaccugcuguacagcgacauccuccugaaguucuccccgaccgagaucaccgcccccaccaugccccuggacugcgcgaacgccagcaacgugcacgccgugaaccgguccgccacgaagggcgucaccuuccuccugcccgagccggaguggaccuacccccggcugagcugccccggguccaccuuccagaaggcccuccugaucagcccccaccgcuucggcgagacgaaggggaacuccgcgccgcugaucauccgggagcccuucaucgccugcggccccaacgagugccgccacuucgcccucacccacuacgccgcgcagcccggcggguacuacaacggcacccgcggggaccggaacaagcugcggcaccugaucagcgugaagcucggcaagaucccgaccguggagaacuccaucuuccacauggccgccuggagcggguccgccugccacgacggcaaggaguggacguacaucggcgucgacgggcccgacaacaacgcccugcugaagaucaaguacggcgaggcguacaccgacaccuaccacagcuacgccaacaacauccuccgcacccaggaguccgccugcaacugcaucgggggcaacugcuaccugaugaucacggacggcagcgccagcgggguguccgagugccgguuccugaagauccgcgagggccggaucaucaaggagaucuuccccaccgggcgcgugaagcacaccgaggagugcacgugcggcuucgccagcaacaagaccaucgagugcgcgugccgggacaacuccuacaccgccaagcgccccuucgucaagcucaacguggagaccgacaccgccgagauccggcugaugugcacggacaccuaccuggacaccccgcgccccgacgacgggagcaucaccggccccugcgaguccaacggcgacaaggggagcggcgggaucaagggcggguucgugcaccagcggauggccuccaagaucggccgcugguacagccggacgauguccaagaccgagcgcaagggcauggggcucuacgucaaguacgacggcgaccccuggaccgacagcgacgcccuggcguuccgcggggugaugguguccaugaaggagccgggcugguacagcuucggguucgagaucaaggacaagaagugcgacguccccugcaucggcaucgagauggugcacgacggcgggaaggagaccuggcacuccgccgccacggccaucuacugccugaugggcagcgggcagcuccugugggacaccgugaccggcgucgacauggcccuguga

SEQ ID NO: 91360 - RNA, 1401 nt, Artificial Sequence; identical to SEQ ID NO: 89964
  derived and/or modified sequence opt1 from neuraminidase__InfluenzaB__AHZ41851

SEQ ID NO: 91361 - RNA, 1401 nt, Artificial Sequence; identical to SEQ ID NO: 91210
  derived and/or modified sequence opt1 from neuraminidase__InfluenzaB__AHZ41862

SEQ ID NO: 91362 - RNA, 1401 nt, Artificial Sequence
  derived and/or modified sequence opt1 from neuraminidase__InfluenzaB__AHZ41873
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgcccaggccgugaaccgcuccgccaccaagggcgugacccuccugcugcccgagccggaguggaccuacccccggcucagcugccccggguccacguuccagaaggcgcugcugaucagcccccaccgcuucggcgagaccaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcgcugcucaaggucaaguacggcgaggccuacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgcgagcaacaagaccaucgagugcgccugccgcgacaaccgguacaccgccaagcgccccuucgucaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucgugcaccagcggaugaaguccaagaucggccgcugguacagccggaccaugagcaagaccgagcgcaugggcauggggcuguacgucaaguacgacggcgaccccugggccgacuccgacgcgcugaccuucagcggggugaugguguccaugaaggagccgggcugguacagcuucggguucgagaucaaggacaagaagugcgacguccccugcaucggcaucgagauggugcacgacggcgggaaggagacguggcacuccgccgccaccgccaucuacugccucaugggcagcgggcagcugcugugggacaccgugaccggcgucgacauggcccucuga

SEQ ID NO: 91363 - RNA, 1401 nt, Artificial Sequence; identical to SEQ ID NO: 89800
  derived and/or modified sequence opt1 from neuraminidase__InfluenzaB__AIL94981

SEQ ID NO: 91364 - RNA, 1401 nt, Artificial Sequence; identical to SEQ ID NO: 89800
  derived and/or modified sequence opt1 from neuraminidase__InfluenzaB__AIL94992

SEQ ID NO: 91365 - RNA, 1401 nt, Artificial Sequence; identical to SEQ ID NO: 89825
  derived and/or modified sequence opt1 from neuraminidase__InfluenzaB__AIL95003

SEQ ID NO: 91366 - RNA, 1401 nt, Artificial Sequence
  derived and/or modified sequence opt1 from neuraminidase__InfluenzaB__AIL95014
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccgcuccgccgccaagggcgucacgcuccugcugcccgagcccgaguggaccuacccgcggcucagcugccccggguccaccuuccagaaggcgcugcugaucagcccccaccgcuucggcgagaccaaggggaacuccgcgccccucaucauccgggagccguucaucgccugcggccccacggagugcaagcacuucgcccugacccacuacgccgcccagcccggcggguacuacaacggcacccgcgaggaccggaacaagcugcgccaccucaucagcgugaagcuggggaagauccccaccguggagaacuccaucuuccacauggccgccuggagcggcuccgccugccacgacgggaaggaguggacguacaucggcgucgacggcccggacagcaacgcgcugcucaagaucaaguacggggaggccuacaccgacaccuaccacuccuacgccaagaacauccugcggacccaggagagcgccugcaacugcaucggcggggacugcuaccugaugaucacggacggccccgccagcggcguguccgagugccgcuuccucaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggcccuucgucaagcugaacguggagaccgacaccgccgagauccgccugaugugcacggagaccuaccucgacaccccgcggcccaacgacggcagcaucaccgggcccugcgaguccgacggcgacaagggcagcgggggcaucaagggcggguucgugcaccagcgcauggccuccaagaucgggcggugguacagccgcacgauguccaagaccaagcggaugggcaugggccuguacgucaaguacgacggggaccccuggaccgacagcgaggcgcuggcccucuccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccugaugggguccggccagcugcucugggacaccgugaccggggucgacaugacgcuguga

SEQ ID NO: 91367 - RNA, 1401 nt, Artificial Sequence; identical to SEQ ID NO: 89825
  derived and/or modified sequence opt1 from neuraminidase__InfluenzaB__AIL95025

SEQ ID NO: 91368 - RNA, 1401 nt, Artificial Sequence
  derived and/or modified sequence opt1 from neuraminidase__InfluenzaB__AIL95036
augcugagcuccaccauccagacccucacgcuguuccugaccagcggcggggugcuccugucccuguacgucagcgccucccucagcuaccugcuguacuccgacauccuccugaaguucagccccaaggagaucaccgccccgaccaugccccuggacugcgcgaacgccuccaacgugcaggccgugaaccacagcgccacgaagggcgucacccuccugcugcccgagcccgaguggaccuacccgcgccucuccugccccgggagcaccuuccagaaggcccugcugaucagcccccaccgguucggcgagacgaaggggaacuccgcgccccucaucauccgcgagccguucaucgccugcggccccaacgagugcaagcacuucgcccugacccacuacgccgcgcagcccggcggguacuacaacggcacccgcggggaccggaacaagcugcggcaccucaucuccgugaagcugggcaagauccccaccguggagaacagcaucuuccacauggccgccugguccgggagcgccugccacgacggcaaggaguggacguacaucggcgucgacgggccggacaacaacgcccugcucaaggugaaguacggcgaggcguacaccgacaccuaccacuccuacgccaacaagauccugcgcacccaggagagcgccugcaacugcaucgggggcaacugcuaccugaugaucacggacggcagcgccuccggggugagcgagugccgguuccucaagauccgcgagggccggaucaucaaggagaucuuccccaccgggcgcgucaagcacaccgaggagugcacgugcggcuucgccuccaacaagaccaucgagugcgcgugccgggacaacagcuacaccgccaagcgccccuucgugaagcugaacguggagaccgacaccgccgagauccggcugaugugcacggacaccuaccucgacacgccccgcccggacgacggguccaucaccggccccugcgagagcaacggcgacaagggguccggcgggaucaagggcggguucguccaccagcggauggagagcaagaucggccgcugguacucccggaccaugagcaagaccgagcgcaugggcauggggcuguacgugaaguacgacggcgaccccugggccgacuccgacgcccuggcguucagcggggugauggucuccaugaaggagcccggcugguacagcuucggguucgagaucaaggacaagaagugcgacgugccgugcaucggcaucgagauggugcacgacggcgggaaggagaccuggcacuccgccgccaccgccaucuacugccucaugggcagcgggcagcugcugugggacacggucaccggcguggacauggcccucuga

SEQ ID NO: 91369 - RNA, 1401 nt, Artificial Sequence; identical to SEQ ID NO: 89825
  derived and/or modified sequence opt1 from neuraminidase__InfluenzaB__AIL95047

SEQ ID NO: 91370 - RNA, 1401 nt, Artificial Sequence; identical to SEQ ID NO: 89934
  derived and/or modified sequence opt1 from neuraminidase__InfluenzaB__AIL95058

SEQ ID NO: 91371 - RNA, 1401 nt, Artificial Sequence; identical to SEQ ID NO: 89883
  derived and/or modified sequence opt1 from neuraminidase__InfluenzaB__AIL95069

SEQ ID NO: 91372 - RNA, 1401 nt, Artificial Sequence
  derived and/or modified sequence opt1 from neuraminidase__InfluenzaB__AIL95080
augcugcccagcaccauccagacccucacgcuguuccugaccuccggcggggugcuccugagccuguacgucuccgccagccucuccuaccugcuguacagcgacauccuccugaaguucuccccgaaggagaucaccgcccccaccaugccccuggacugcgcgaacgccagcaacgugcaggccgugaaccacuccgccacgaagggcgucacccuccugcugcccgagccggaguggaccuacccccgccucagcugccccggguccaccuuccagaaggcccugcugaucagcccccaccgguucggcgagacgaaggggaacuccgcgccgcucaucauccgcgagcccuucaucgccugcggccccaacgagugcaagcacuucgcccugacccacuacgccgcgcagcccggcggguacuacaacggcacccgcggggaccggaacaagcugcggcaccucaucagcgugaagcugggcaagaucccgaccguggagaacuccaucuuccacauggccgccuggagcggguccgccugcaacgacggcaaggaguggacguacaucggcgucgacgggcccgacaacaacgcccugcucaaggugaaguacggcgaggcguacaccgacaccuaccacagcuacgccaacaagauccugcgcacccaggaguccgccugcaacugcaucgggggcaacugcuaccugaugaucacggacggcagcgccagcgggguguccgagugccgguuccucaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgccccuucgugaagcugaacguggagaccgacaccgccgagauccggcugaugugcacggacaccuaccucgacaccccgcgccccgacgacgggagcaucaccggccccugcgaguccaacggcgacaaggggagcggcgggaucaagggcggguucguccaccagcggauggaguccaagaucggccgcugguacagccggacgauguccaagaccgagcgcaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccucaugggcuccgggcagcugcugugggacacggucaccggcguggacauggcccucuga

SEQ ID NO: 91373 - RNA, 1401 nt, Artificial Sequence; identical to SEQ ID NO: 89883
  derived and/or modified sequence opt1 from neuraminidase__InfluenzaB__AIL95091

SEQ ID NO: 91374 - RNA, 1401 nt, Artificial Sequence; identical to SEQ ID NO: 89825
  derived and/or modified sequence opt1 from neuraminidase__InfluenzaB__AIL95102

SEQ ID NO: 91375 - RNA, 1401 nt, Artificial Sequence
  derived and/or modified sequence opt1 from neuraminidase__InfluenzaB__AIL95113
augcugcccagcaccauccagacccucacgcuguuccugaccuccggcggggugcuccugagccuguacgucuccgccagccucuccuaccugcuguacagcgacauccuccugaaguucuccccgaccggcaucaccgcccccacgaugccccuggacugcgcgaacgccagcaacgugcaggccgugaaccgcuccgccaccaagggggucacccuccugcccccggagcccgaguggaccuacccccggcugagcugccccggcuccacguuccagaaggcccuccugaucagcccgcaccgcuucggggagaccaagggcaacuccgcgccccugaucauccgggagcccuucaucgccugcggccccaacgagugcaagcacuucgcccucacccacuacgccgcgcagcccgggggcuacuacaacgggacccgcggcgaccggaacaagcugcgccaccugaucagcgugaagcucgggaagauccccacgguggagaacuccaucuuccacauggccgccuggagcggcuccgccugccacgacggcaaggaguggaccuacaucggggucgacggccccgacaacaacgcccugcugaaggugaaguacggggaggcguacaccgacaccuaccacagcuacgccaacaagauccuccggacgcaggaguccgccugcaacugcaucggcggcaacugcuaccugaugaucaccgacgggagcgccagcggcguguccgagugccgcuuccugaagauccgggaggggcgcaucaucaaggagaucuuccccaccggccgggucaagcacaccgaggagugcacgugcggguucgccagcaacaagaccaucgagugcgcgugccgcgacaaccgguacaccgccaagcgcccguucgugaagcucaacguggagaccgacacggccgagauccggcugaugugcaccgacaccuaccuggacaccccgcgccccaacgacggcuccaucacgggccccugcgagagcgacggggacaagggcuccgggggcaucaagggcggguucguccaccagcggaugaaguccaagaucggccgcugguacagccggaccaugagcaagaccgagcgcauggggaugggccucuacgugaaguacgacggggacccgugggccgacuccgacgcccuggcguucagcggcgugauggucuccaugaaggagcccgggugguacagcuucggcuucgagaugaaggacaagaagugcgacgugcccugcaucggcaucgagauggugcacgacgggggcaaggagaccuggcacuccgccgccacggccaucuacugccugauggggagcggccagcuccugugggacaccgucaccggcguggacauggcccuguga

SEQ ID NO: 91376 - RNA, 1401 nt, Artificial Sequence; identical to SEQ ID NO: 91322
  derived and/or modified sequence opt1 from neuraminidase__InfluenzaB__AIL95124

SEQ ID NO: 91377 - RNA, 1401 nt, Artificial Sequence
  derived and/or modified sequence opt1 from neuraminidase__InfluenzaB__AKA54777
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaccgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagacgaccuggcacagcgccgccaccgccaucuacugccucaugggguccggccagcugcugugggacaccgugacgggggucaacaugacccucuga

SEQ ID NO: 91378 - RNA, 1401 nt, Artificial Sequence
  derived and/or modified sequence opt1 from neuraminidase__InfluenzaB__AKA54781
augcugcccagcaccauccagacccucacgcuguuccugaccuccggcggggugcuccugagccuguacgucuccgccagccucuccuaccugcuguaccucgacauccugcugaaguucccgagcaccgagaucaccgcccccacgaugccccucgacugcgcgaacgccuccaacgugcaggccgugaaccgcagcgccaccaagggcgucaccuuccugcugcccgagccggaguggaccuacccccggcucuccugccccgggagcacguuccagaaggcccugcugaucagcccccaccgcuucggcgagaccaaggggaacuccgcgccgcucaucauccgggagcccuucaucgccugcggccccaaggagugcaagcacuucgcccugacccacuacgccgcgcagcccggcggguacuacaacggcacccgcggggaccggaacaagcugcgccaccucaucuccgugaagcugggcaagaucccgacgguggagaacagcaucuuccacauggccgccugguccgggagcgccugccacgacggcaaggaguggaccuacaucggcgucgacgggcccgacaacaacgcccugcucaagaucaaguacggcgaggcguacaccgacaccuaccacuccuacgccaacaacauccugcggacgcaggagagcgccugcaacugcaucgggggcaacugcuaccugaugaucaccgacggcuccgccagcggggugagcgagugccgcuuccucaagauccgggagggccgcaucaugaaggagaucuuccccaccgggcggacccagcacacggaggagugcacgugcggcuucgccuccaacaagaccaucgagugcgugugccgcgacaacagcuacaccgcgaagcggcccuucgucaagcugaacguggagaccgacaccgccgagauccgccugaugugcaccaagaccuaccucgacacgccgcggcccgacgacggguccaucaccggccccugcgagagcaacggcgggaagggcuccgggggcaucaagggcggguucgugcaccagcgcauggccagcaagaucggccggugguacucccgcaccaugagcaagaccgagcggaaggggaugggccuguacgucaaguacaacggggaccccugggccgacuccgacgcccugacguucagcggcgugaugguguccauggaggagccggggugguacagcuucggcuucgagaucaaggacaagaagugcgacguccccugcaucggcaucgagauggugcacgacgggggcaaggagaccuggcacuccgcggccaccgccaucuacugccucauggggagcggccagcugcugugggacaccgugacgggcgucaacaugacccucuga

SEQ ID NO: 91379 - RNA, 1401 nt, Artificial Sequence
  derived and/or modified sequence opt1 from neuraminidase__InfluenzaB__AKA54783
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccucuuccccgagccggaguggaccuacccccgccugagcugccccggguccaccuuccagaaggcccugcucaucagcccccaccgguucggcgagaccaaggggaacuccgcgccgcugaucauccgcgagcccuucaucgccugcggccccaaggagugcaagcacuucgcccugacccacuacgccgcgcagcccggcggguacuacaacggcacccgggaggaccgcaacaagcuccggcaccugaucagcgugaagcuggggaagaucccgaccgucgagaacuccaucuuccacauggccgccuggagcggcuccgccugccacgacgggcgcgaguggacguacaucggcguggacggccccgacagcaacgcccuccugaagaucaaguacggggaggcguacaccgacaccuaccacuccuacgccaagaacauccugcggacccaggagagcgccugcaacugcaucggcggggacugcuaccucaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcugaacguggagaccgacaccgccgagauccgccucaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccuguacgucaaguacgacggggacccguggaccgacagcgaggcccucgcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccugaugggguccggccagcuccugugggacaccgugaccggggucaacaugacgcuguga

SEQ ID NO: 91380 - RNA, 1401 nt, Artificial Sequence
  derived and/or modified sequence opt1 from neuraminidase__InfluenzaB__AKA54785
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcaacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91381 - RNA, 1401 nt, Artificial Sequence
  derived and/or modified sequence opt1 from neuraminidase__InfluenzaB__AKA54787
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaucaaggggaacuccgcgccccucaucauccgcgagccguucaucgccugcggccccaccgagugcaagcacuucgcccugacgcacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgccaagaacauccugcgcacccaggagagcgccugcaacugcaucggcggggacugcuaccugaugaucaccgacggccccgccagcggcguguccgagugccgguuccucaagauccgcgaggggcggaucaucaaggagaucuuccccacgggccgcgugaagcacaccgaggagugcacgugcggguucgcgagcaacaagaccaucgagugcgccugccgggacaaccgcuacaccgccaagcggcccuucgucaagcugaacguggagaccgacaccgccgagauccgccugaugugcaccgagacguaccucgacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccuguacgucaaguacgacggggaccccuggaccgacuccgaggcgcuggcccucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcgcuguga

SEQ ID NO: 91382 - RNA, 1401 nt, Artificial Sequence
  derived and/or modified sequence opt1 from neuraminidase__InfluenzaB__AKA54789
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91383 - RNA, 1401 nt, Artificial Sequence
  derived and/or modified sequence opt1 from neuraminidase__InfluenzaB__AKA54791
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgcccaggccgugaaccgguccgccacgaagggcgucacgccccuccugcccgagccggaguggaccuacccccgccugagcugccccggguccaccuuccagaaggcgcuccugaucagcccccaccgguucggcgagaccaaggggaacuccgccccgcugaucauccgcgagcccuucaucgccugcggccccaaggagugcaagcacuucgcccucacccacuacgcggcccagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggccguucgugaagcucaacgucgagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgugaaguacgacggggacccguggaccgacagcgaggcgcuggcccuguccggcgucauggugagcauggaggagcccgggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccggggugaacaucacgcucuga

SEQ ID NO: 91384 - RNA, 1401 nt, Artificial Sequence; identical to SEQ ID NO: 91381
  derived and/or modified sequence opt1 from neuraminidase__InfluenzaB__AKA54793

SEQ ID NO: 91385 - RNA, 1401 nt, Artificial Sequence; identical to SEQ ID NO: 91381
  derived and/or modified sequence opt1 from neuraminidase__InfluenzaB__AKA54795

SEQ ID NO: 91386 - RNA, 1401 nt, Artificial Sequence; identical to SEQ ID NO: 91382
  derived and/or modified sequence opt1 from neuraminidase__InfluenzaB__AKA54797

SEQ ID NO: 91387 - RNA, 1401 nt, Artificial Sequence
  derived and/or modified sequence opt1 from neuraminidase__InfluenzaB__AKA54799
augcugcccagcaccauccagacccucacgcuguuccugaccuccggcggggugcuccugagccuguacgucuccgccagccucuccuaccugcuguacagcgacauccuccugaaguucucccagaccgagaucaccgccccgaucaugccccuggacugcgcgaacgccagcaacgugcaggccgugaaccacuccgccgccaagggcgucacgcuccugcugcccgagcccgaguggaccuacccgcgccucagcugccccggguccaccuuccagaaggcgcugcugaucagcccccaccgguucggcgagaucaaggggaacuccgcgccccucaucauccgcgagccguucaucgccugcggccccaccgagugcaagcacuucgcccugacgcacuacgccgcccagcccggcggguacuacaacggcacccgggaggaccgcaacaagcugcggcaccucaucagcgugaagcuggggaagauccccaccguggagaacuccaucuuccacauggccgccuggagcggcuccgccugccacgacgggaaggaguggaccuacaucggcgucgacggcccggacagcaacgcgcugcucaagaucaaguacggggaggccuacacggacaccuaccacuccuacgagaagaacauccugcgcacccaggagagcgccugcaacugcaucggcggggacugcuaccugaugaucaccgacggccccgccagcggcguguccgagugccgguuccucaagauccgcgaggggcggaucaucaaggagaucuuccccacgggccgcgugaagcacaccgaggagugcacgugcggguucgccagcaacaagaccaucgagugcgcgugccgggacaaccgcuacaccgccaagcggcccuucgucaagcugaacguggagaccgacaccgccgagauccgccugaugugcaccgagacguaccucgacaccccgcggcccaacgacggcuccaucaccgggcccugcgagagcgacggcgacaagggcuccgggggcaucaagggcggguucgugcaccagcgcauggccagcaagaucgggcggugguacucccgcaccaugagcaagacgaagcggaugggcaugggccuguacgucaaguacgacggggaccccuggaccgacuccgaggcccuggcgcucagcggcgugaugguguccauggaggagccggggugguacagcuucggcuucgagaucaaggacaagaagugcgacguccccugcaucgggaucgagauggugcacgacggcggcaagaccaccuggcacuccgccgccacggccaucuacugccugauggggagcggccagcugcucugggacaccgugaccggggucgacauggcccuguga

SEQ ID NO: 91388 - RNA, 1401 nt, Artificial Sequence; identical to SEQ ID NO: 91382
  derived and/or modified sequence opt1 from neuraminidase__InfluenzaB__AKA54801

SEQ ID NO: 91389 - RNA, 1401 nt, Artificial Sequence
  derived and/or modified sequence opt1 from neuraminidase__InfluenzaB__AKA54803
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaacggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91390 - RNA, 1401 nt, Artificial Sequence; identical to SEQ ID NO: 91382
  derived and/or modified sequence opt1 from neuraminidase__InfluenzaB__AKA54805

SEQ ID NO: 91391 - RNA, 1401 nt, Artificial Sequence
  derived and/or modified sequence opt1 from neuraminidase__InfluenzaB__AKA54807
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaucacgcucuga

SEQ ID NO: 91392 - RNA, 1401 nt, Artificial Sequence
  derived and/or modified sequence opt1 from neuraminidase__InfluenzaB__AKA54809
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuucaagaucgggcggugguacucccgcaccaugagcaagaccaagcggaugggcaugggccucuacgucaaguacgacggggacccguggaccgacuccgaggcccuggcgcugagcggcgugaugguguccauggaggagcccgggugguacagcuucggcuucgagaucaaggacaagaagugcgacguccccugcaucgggaucgagauggugcacgacggcggcaagaccacguggcacuccgccgccaccgccaucuacugccucauggggagcggccagcugcugugggacaccgugaccggggucaacaugacgcucuga

SEQ ID NO: 91393 - RNA, 1401 nt, Artificial Sequence; identical to SEQ ID NO: 91382
  derived and/or modified sequence opt1 from neuraminidase__InfluenzaB__AKA54811

SEQ ID NO: 91394 - RNA, 1401 nt, Artificial Sequence
  derived and/or modified sequence opt1 from neuraminidase__InfluenzaB__AKA54813
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcaucgaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91395 - RNA, 1401 nt, Artificial Sequence; identical to SEQ ID NO: 91382
  derived and/or modified sequence opt1 from neuraminidase__InfluenzaB__AKA54815

SEQ ID NO: 91396 - RNA, 1401 nt, Artificial Sequence
  derived and/or modified sequence opt1 from neuraminidase__InfluenzaB__AKA54817
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggguggagauggugcacgacggcggcaagaccacguggcacagcgccgccaccgccaucuacugccucaugggguccggccagcugcugugggacaccgucaccggggugaacaugacgcucuga

SEQ ID NO: 91397 - RNA, 1401 nt, Artificial Sequence; identical to SEQ ID NO: 91382
  derived and/or modified sequence opt1 from neuraminidase__InfluenzaB__AKA54819

SEQ ID NO: 91398 - RNA, 1401 nt, Artificial Sequence; identical to SEQ ID NO: 91382
  derived and/or modified sequence opt1 from neuraminidase__InfluenzaB__AKA54821

SEQ ID NO: 91399 - RNA, 1401 nt, Artificial Sequence; identical to SEQ ID NO: 91382
  derived and/or modified sequence opt1 from neuraminidase__InfluenzaB__AKA54823

SEQ ID NO: 91400 - RNA, 1401 nt, Artificial Sequence; identical to SEQ ID NO: 91382
  derived and/or modified sequence opt1 from neuraminidase__InfluenzaB__AKA54825

SEQ ID NO: 91401 - RNA, 1401 nt, Artificial Sequence; identical to SEQ ID NO: 91382
  derived and/or modified sequence opt1 from neuraminidase__InfluenzaB__AKA54827

SEQ ID NO: 91402 - RNA, 1401 nt, Artificial Sequence
  derived and/or modified sequence opt1 from neuraminidase__InfluenzaB__AKA54829
augcugcccagcaccauccagacccucacgcuguuccugaccuccggcggggugcuccugagccuguacgucuccgccagccucuccuaccugcuguacagcgacauccuccugaagcugucccgcaccgaggugaccgccccgaucaugccccucgacugcgcgaacgccagcaacgugcaggccgucaaccgguccgccacgaagggcgugacgccccugcugcccgagccggaguggaccuacccccgccucagcugccccggguccaccuuccagaagacccugcugaucagcccccaccgguucggcgagaccaaggggaacuccgccccgcucaucauccgcgagcccuucaucgcgugcggccccaaggagugcaagcacuucgcccugacccacuacgccgcccagcccggcggguacuacaacggcacccgggaggaccgcaacaagcugcggcaccucaucagcgugaagcuggggaagaucccgacggucgagaacuccaucuuccacauggcggccuggagcggcuccgccugccacgacgggcgcgaguggaccuacaucggcguggacggccccgacagcaacgcccugcucaagaucaaguacggggaggccuacaccgacaccuaccacuccuacgcgaagaacauccugcggacgcaggagagcgccugcaacugcaucggcggggacugcuaccugaugaucaccgacggccccgccagcggcaucuccgagugccgcuuccucaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggccguucgucaagcugaacguggagaccgacacggccgagauccgccugaugugcaccaagaccuaccucgacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccuguacgucaaguacgacggggacccguggaccgacagcgaggcccuggcccucuccggcgugauggugagcauggaggagcccgggugguacuccuucggcuucgagaucaaggacaagaagugcgacguccccugcaucgggaucgagauggugcacgacggcggcaagacgaccuggcacagcgcggccaccgccaucuacugccugaugggguccggccagcugcucugggacaccgugacgggggucaacaugacccuguga

SEQ ID NO: 91403 - RNA, 1401 nt, Artificial Sequence
  derived and/or modified sequence opt1 from neuraminidase__InfluenzaB__AKA54831
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccaggacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggcccuucgucaagcucaacguggagaccgacaccgccgagauccgccugaugugcacgaagaccuaccuggacaccccgcggcccaacgacggcagcaucaccgggcccugcgaguccgacggcgacgagggcagcgggggcaucaagggcggguucgugcaccagcgcauggccuccaagaucgggcggugguacagccgcacgauguccaagaccaagcggaugggcaugggccucuacgucaaguacgacggggaccccuggaccgacagcgaggcccuggcgcuguccggcgugauggugagcauggaggagccggggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91404 - RNA, 1401 nt, Artificial Sequence; identical to SEQ ID NO: 91382
  derived and/or modified sequence opt1 from neuraminidase__InfluenzaB__AKA54833

SEQ ID NO: 91405 - RNA, 1401 nt, Artificial Sequence
  derived and/or modified sequence opt1 from neuraminidase__InfluenzaB__AKA54837
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaacgggaacuccgcgccgcucaucgugcgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaaccgguacaccgccaagcgccccuucgugaagcugaacgucgagaccgacacggccgagauccggcugaugugcaccgacaccuaccucgacaccccgcgccccaacgacggguccaucacgggccccugcgagagcgacggcaacgagggguccggcgggaucaagggcggguucgugcaccagcggaugaaguccaagaucggccgcugguacagccggaccaugagcaagaccgagcgcaugggcauggggcuguacgugaaguacgacggcgaccccugggccgacuccgacgcccuggcguucagcggggucaugguguccaugaaggagccgggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcguggacauggcccucuga

SEQ ID NO: 91406 - RNA, 1401 nt, Artificial Sequence
  derived and/or modified sequence opt1 from neuraminidase__InfluenzaB__AKA54839
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaaggaggucacccuccugcugcccgagccggaguggaccuacccccggcucagcugccccggcuccacguuccagaaggcccugcugaucagcccccaccgcuucggggagaccaagggcaacuccgcgccgcucaucauccgggagcccuucaucgccugcgggcccaacgagugcaagcacuucgcccugacccacuacgccgcgcagcccggcggcuacuacaacgggacccgcggcgaccggaacaagcugcgccaccucaucagcgugaagcuggggaagaucccgacgguggagaacuccaucuuccacauggccgccuggagcggcuccgccugccacgacgggaaggaguggaccuacaucggcgucgacggccccgacaacaacgcccugcucaaggugaaguacggggaggcguacaccgacaccuaccacagcuacgccaacaagauccugcggacgcaggaguccgccugcaacugcaucggcgggaacugcuaccugaugaucaccgacggcagcgccagcggcguguccgagugccgcuuccucaagauccgggaggggcgcaucaucaaggagaucuuccccaccggccgggucaagcacaccgaggagugcacgugcggguucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggcuccaucacggggcccugcgagagcgacggcgacaagggcuccgggggcaucaagggcggguucguccaccagcggaugaaguccaagaucgggcgcugguacagccggaccaugagcaagaccgagcgcaugggcaugggccuguacgugaaguacgacggggaccccugggccgacuccgacgcccuggcguucagcggcgugauggucuccaugaaggagccggggugguacagcuucggcuucgagaucaaggacaagaagugcgacgugcccugcaucgggaucgagauggugcacgacggcggcaaggagaccuggcacuccgccgccacggccaucuacugccucauggggagcggccagcugcugugggacaccgucaccgggguggacauggcccucuga

SEQ ID NO: 91407 - RNA, 1401 nt, Artificial Sequence
  derived and/or modified sequence opt1 from neuraminidase__InfluenzaB__AKA54841
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccgugaaggagccgggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcguggacaucgcccucuga

SEQ ID NO: 91408 - RNA, 1401 nt, Artificial Sequence
  derived and/or modified sequence opt1 from neuraminidase__InfluenzaB__AKA54843
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccgugaaggagccgggcugguacagcuucggguucgagaucaaggacaagaagugcgacgugcccugcaucggcaucgagaugguccacgacggcgggaaggagaccuggcacuccgccgccacggccaucuacugccucaugggcagcgggcagcugcugugggacaccgugaccggcguggacauggcccucuga

SEQ ID NO: 91409 - RNA, 1401 nt, Artificial Sequence
  derived and/or modified sequence opt1 from neuraminidase__InfluenzaB__AKA54845
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaacgggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91410 - RNA, 1401 nt, Artificial Sequence; identical to SEQ ID NO: 91214
  derived and/or modified sequence opt1 from neuraminidase__InfluenzaB__AKA54847

SEQ ID NO: 91411 - RNA, 1401 nt, Artificial Sequence
  derived and/or modified sequence opt1 from neuraminidase__InfluenzaB__AKA54849
augcugcccagcaccauccagacccucacgcuguuccugaccuccggcggggugcuccugagccuguacgucuccgccagccucuccuaccugcuguacagcgacauccuccugaaguucuccagcaccgagaucaccgccccgacgaugccccuggacugcgcgaacgccuccaacgugcaggccgugaaccgcagcgccaccaagggcgucacccuccugcugcccgagcccgaguggaccuacccgcggcucuccugccccgggagcacguuccagaaggcccugcugaucagcccccaccgcuucggcgagaccaacgggaacagcgcgccccucaucauccgggagccguucaucgccugcggccccaacgagugcaagcacuucgcccugacccacuacgccgcgcagcccggcggguacuacaacggcacccgcggggaccggaacaagcugcgccaccucaucuccgugaagcugggcaagauccccacgguggagaacagcaucuuccacauggccgccugguccgggagcgccugccacgacggcaaggaguggaccuacaucggcgucgacgggccggacaacaacgcccugcucaaggugaaguacggcgaggcguacaccgacaccuaccacuccuacgccaacaagauccugcggacgcaggagagcgccugcaacugcaucgggggcaacugcuaccugaugaucaccgacggcagcgccuccggggugagcgagugccgcuuccucaagauccgggagggccgcaucaucaaggagaucuuccccaccgggcgggucaagcacaccgaggagugcacgugcggcuucgccuccaacaagaccaucgagugcgcgugccgcgacaaccgguacaccgccaagcgccccuucgugaagcugaacguggagaccgacacggccgagauccggcugaugugcaccgacaccuaccucgacacgccccgcccgaacgacgggagcaucaccggccccugcgaguccgacggcgacgagggcggcgggggcaucaagggcggguucguccaccagcggaugaaguccaagaucgggcgcugguacucccggaccaugagcaagaccgagcgcauggggaugggccuguacgugaaguacgacggggaccccugggccgacuccgacgcccuggcguucagcggcgugauggucuccaugaaggagcccgggugguacagcuucggcuucgagaucaaggacaagaagugcgacgugccgugcaucggcaucgagauggugcacgacgggggcaaggagaccuggcacuccgccgccacggccaucuacugccucauggggagcggccagcugcugugggacaccgucaccggcguggacauggcccucuga

SEQ ID NO: 91412 - RNA, 1401 nt, Artificial Sequence
  derived and/or modified sequence opt1 from neuraminidase__InfluenzaB__AKA54851
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaucgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacaccgccgagauccggcugaugugcacggacaccuaccucgacaccccgcgccccaacgacggguccaucaccggccccugcgagagcgacggcgacaagggguccggcgggaucaagggcggguucguccaccagcggaugaaguccaagaucggccgcugguacagccggacgaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccaccgccaucuacugccucaugggcagcgggcagcugcugugggacacggucaccggcguggacauggcccucuga

SEQ ID NO: 91413 - RNA, 1401 nt, Artificial Sequence
  derived and/or modified sequence opt1 from neuraminidase__InfluenzaB__AKA54853
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacgagggguccggcggggucaagggcggguucgugcaccagcggaugaaguccaagaucggccgcugguacagccggaccaugagcaagaccgagcgcaugggcauggggcuguacgugaaguacgacggcgaccccugggccgacuccgacgcccuggcguucagcggggucaugguguccgugaaggagccgggcugguacagcuucggguucgagaucaaggacaagaagugcgacguccccugcaucggcaucgagauggugcacgacggcgggaaggagaccuggcacuccgccgccacggccaucuacugccucaugggcagcgggcagcugcugugggacaccgugaccggcgucgacauggcccucuga

SEQ ID NO: 91414 - RNA, 1401 nt, Artificial Sequence
  derived and/or modified sequence opt1 from neuraminidase__InfluenzaB__AKA54855
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcuggacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccgacgcccuggcguucagcggggugauggucuccaugaaggagccgggcugguacagcuucggguucgagaucaaggacaagaagugcgacgugcccugcaucggcaucgagauggugcacgacggcgggaaggagaccuggcacuccgccgccacggccaucuacugccucaugggcagcgggcagcugcugugggacaccgucaccggcguggacauggcccucuga

SEQ ID NO: 91415 - RNA, 1401 nt, Artificial Sequence
  derived and/or modified sequence opt1 from neuraminidase__InfluenzaB__AKT07927
augcccccgagcaccauccagacccugacccucuuccugaccuccggcggggugcugcucagccuguacgucuccgccagccuguccuaccuccuguacagcgacauccugcucaaguucucccccaccgagaucaccgcccccacgaugccccuggacugcgcgaacgccagcaacgugcaggccgugaaccgcuccgccaccaagggcgucacccugcuccugccggagcccgaguggaccuacccccggcugagcugccccggguccacguuccagaaggcccuccugaucagcccgcaccgcuucggcgagacccgggggaacuccgcgccccugaucauccgcgagcccuucaucgccugcggccccaacgagugcaagcacuucgcccucacccacuacgccgcgcagccgggcggguacuacaacggcacccgcggggaccggaacaagcugcggcaccugaucagcgugaagcucggcaagauccccacgguggagaacuccaucuuccacauggccgccuggagcggguccgccugccacgacggcaaggaguggaccuacaucggcgucgacgggcccgacaacaacgcccugcugaaggugaaguacggcgaggcguacaccgacaccuaccacagcuacgccaacaagauccuccgcacgcaggaguccgccugcaacugcaucgggggcaacugcuaccugaugaucaccgacggcagcgccagcgggguguccgagugccgguuccugaagauccgcgagggccggaucaucaaggagaucuuccccaccgggcgcgucaagcacaccgaggagugcacgugcggcuucgccagcaacaagaccaucgagugcgcgugccgggacaacuccuacaccgccaagcgcccguucgugaagcucaacguggagaccgacacggccgagauccggcugaugugcaccgacaccuaccuggacacgccccgccccaacgacgggagcaucacgggccccugcgaguccgacggcgacaaggggagcggcgggaucaagggcggguucguccaccagcggauggaguccaagaucggccgcugguacagccggaccauguccaagaccgagcgcaugggcauggggcucuacgugaaguacgacggcgacccguggaccgacagcgacgcccuggccuucgggggcgugauggucuccaugaaggagcccgggugguacagcuucggcuucgagaucaaggacaagaagugcgacgugcccugcaucggcaucgagauggugcacgacgggggcaaggagacguggcacuccgcggccaccgccaucuacugccugauggggagcggccagcuccugugggacaccgucaccggcguggacauggcccuguga

SEQ ID NO: 91416 - RNA, 1401 nt, Artificial Sequence; identical to SEQ ID NO: 90127
  derived and/or modified sequence opt1 from neuraminidase__InfluenzaB__AKT07931

SEQ ID NO: 91417 - RNA, 1401 nt, Artificial Sequence
  derived and/or modified sequence opt1 from neuraminidase__InfluenzaB__AKT07933
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucaccuuccuccugcccgagccggaguggaccuacccccggcugagcugccccggguccaccuuccagaaggcgcuccugaucagcccccaccgcuucggcgagacgaaggggaacuccgccccgcugaucauccgggagcccuucaucgccugcggccccaacgagugcaagcacuucgcccucacccacuacgcggcccagcccggcggguacuacaacggcacccgcggggaccggaacaagcugcgccaccugaucagcgugaagcucggcaagaucccgaccguggagaacuccaucuuccacauggccgccuggagcggguccgccugccacgacggcaaggaguggacguacaucggcgucgacgggcccgacaacaacgcgcugcugaaggugaaguacggcgaggccuacaccgacaccuaccacagcuacgccaacaagauccuccggacccaggaguccgccugcaacugcaucgggggcaacugcuaccugaugaucacggacggcagcgccagcgggguguccgagugccgcuuccugaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcucaacguggagaccgacaccgccgagauccgccugaugugcacggacaccuaccuggacaccccgcggcccaacgacgggagcaucaccggccccugcgaguccgacggcgacaaggggagcggcgggaucaagggcggguucguccaccagcgcauggaguccaagaucggccggugguacagccgcacgauguccaagaccgagcggaugggcauggggcucuacgugaaguacgacggcgaccccugggccgacagcgacgcgcuggccuucuccggggugauggucagcaugaaggagccgggcugguacuccuucggguucgagaucaaggacaagaagugcgacgugcccugcaucggcaucgagauggugcacgacggcgggaaggagaccuggcacagcgccgccaccgccaucuacugccugaugggcuccgggcagcuccugugggacacggucaccggcguggacauggcgcuguga

SEQ ID NO: 91418 - RNA, 1401 nt, Artificial Sequence; identical to SEQ ID NO: 90127
  derived and/or modified sequence opt1 from neuraminidase__InfluenzaB__AKT07935

SEQ ID NO: 91419 - RNA, 1401 nt, Artificial Sequence; identical to SEQ ID NO: 90127
  derived and/or modified sequence opt1 from neuraminidase__InfluenzaB__AKT07937

SEQ ID NO: 91420 - RNA, 1401 nt, Artificial Sequence; identical to SEQ ID NO: 89969
  derived and/or modified sequence opt1 from neuraminidase__InfluenzaB__AKT07939

SEQ ID NO: 91421 - RNA, 1401 nt, Artificial Sequence; identical to SEQ ID NO: 90127
  derived and/or modified sequence opt1 from neuraminidase__InfluenzaB__AKT07941

SEQ ID NO: 91422 - RNA, 1401 nt, Artificial Sequence; identical to SEQ ID NO: 90127
  derived and/or modified sequence opt1 from neuraminidase__InfluenzaB__AKT07945

SEQ ID NO: 91423 - RNA, 1401 nt, Artificial Sequence
  derived and/or modified sequence opt1 from neuraminidase__InfluenzaB__AKT07947
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccgcgaugccccuggacugcgccaacgccagcaacgugcaggccgugaaccgcuccgccacgaagggcgucacccuccugcugcccgagccggaguggaccuacccccggcucagcugccccggguccaccuuccagaaggcgcugcugaucagcccccaccgcuucggcgagacgaaggggaacuccgccccgcucaucauccgggagcccuucaucgccugcggccccaacgagugcaagcacuucgcccugacccacuacgcggcccagcccggcggguacuacaacggcacccgcggggaccggaacaagcugcgccaccucaucagcgugaagcugggcaagaucccgaccguggagaacuccaucuuccacauggccgccuggagcggguccgccugccacgacggcaaggaguggacguacaucggcgucgacgggcccgacaacaacgcgcugcucaaggugaaguacggcgaggccuacaccgacaccuaccacagcuacgccaacaagauccugcggacccaggaguccgccugcaacugcaucgggggcaacugcuaccugaugaucacggacggcagcgccagcgggguguccgagugccgcuuccucaagauccgggagggccgcaucaucaaggagaucuuccccaccgggcgggucaagcacaccgaggagugcacgugcggcuucgcgagcaacaagaccaucgagugcgccugccgcgacaacuccuacaccgccaagcggcccuucgugaagcugaacguggagaccgacaccgccgagauccgccugaugugcacggacaccuaccucgacaccccgcggcccaacgacgggagcaucaccggccccugcgaguccgacggcgacaaggggagcggcgggaucaagggcggguucguccaccagcgcauggaguccaagaucggccggugguacagccgcacgauguccaagaccgagcggaugggcauggggcuguacgugaaguacgacggcgaccccugggccgacagcgacgcgcuggccuucuccggggugauggucagcaugaaggagccgggcugguacuccuucggguucgagaucaaggacaagaagugcgacgugcccugcaucggcguggacaugguccacgacugcggcaaggagaccuggcacagcgccgccaccgccaucuacugccucaugggguccggccagcugcugugggacacggugaccgggguggacauggcgcucuga

SEQ ID NO: 91424 - RNA, 1401 nt, Artificial Sequence; identical to SEQ ID NO: 91382
  derived and/or modified sequence opt1 from neuraminidase__InfluenzaB__AKU40585

SEQ ID NO: 91425 - RNA, 1401 nt, Artificial Sequence; identical to SEQ ID NO: 91382
  derived and/or modified sequence opt1 from neuraminidase__InfluenzaB__AKU40596

SEQ ID NO: 91426 - RNA, 1401 nt, Artificial Sequence
  derived and/or modified sequence opt1 from neuraminidase__InfluenzaB__AKU40607
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucacgccccuggacugcgcgaacgccagcaacgcccaggccgugaaccgguccgccaccaagggcgucacgccccuccugcccgagccggaguggaccuacccccgccugagcugccccggguccaccuuccagaaggcgcuccugaucagcccccaccgguucggcgagaccaaggggaacuccgccccgcugaucauccgcgagcccuucaucgccugcggccccaaggagugcaagcacuucgcccucacccacuacgcggcccagcccggcggguacuacaacggcacccgggaggaccgcaacaagcugcggcaccugaucagcgugaagcucgggaagaucccgacgguggagaacuccaucuuccacauggccgccuggagcggcuccgccugccacgacgggcgcgaguggaccuacaucggcgucgacggccccgacagcaacgcgcugcugaagaucaaguacggggaggccuacaccgacaccuaccacuccuacgccaagaacauccuccggacgcaggagagcgccugcaacugcaucggcggggacugcuaccugaugaucaccgacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggccguucgugaagcucaacgucgagaccgacacggccgagauccgccugaugugcaccaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgugaaguacgacggggacccguggaccgacagcgaggcgcuggcccuguccggcgucauggugagcauggaggagcccgggugguacuccuucggcuucgagaucaaggacaagaagugcgacgugcccugcaucgggaucgagaugguccacgacggcggcaagacgaccuggcacagcgccgccaccgccaucuacugccucaugggguccggccagcugcugugggacaccgugacgggggugaacaugacccucuga

SEQ ID NO: 91427 - RNA, 1401 nt, Artificial Sequence
  derived and/or modified sequence opt1 from neuraminidase__InfluenzaB__AKU40618
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaacaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91428 - RNA, 1401 nt, Artificial Sequence
  derived and/or modified sequence opt1 from neuraminidase__InfluenzaB__AKU40640
augcugcccagcaccauccagacccucacgcuguuccugaccuccggcggggugcuccugagccuguacgucuccgccagccucuccuaccugcuguacagcgacauccuccugaaguucucccgcaccgagaucgccgcgccgaucaugccccuggacugcgccaacgccagcaacgugcaggccgugaaccgguccgccaccaagggcgucgcgcuccugcugcccgagcccgaguggacguacccgcgccucagcugccccggguccaccuuccagaaggcccugcugaucagcccccaccgguucggcgagaccaaggggaacuccgcgccccucaucauccgcgagccguucaucgccugcggccccaaggagugcaagcacuucgcccugacccacuacgccgcccagcccggcggguacuacaacggcacgcgggaggaccgcaacaagcugcggcaccucaucagcgugaagcuggggaagauccccaccguggagaacuccaucuuccacauggccgccuggagcggcuccgcgugccacgacgggcgcgaguggaccuacaucggcgucgacggcccggacaacaacgcccugcucaagaucaaguacggggaggccuacaccgacacguaccacagcuacgccaagaacauccugcggacccaggaguccgccugcaacugcaucggcggggacugcuaccugaugaucaccgacggccccgcgagcggcaucagcgagugccgcuuccucaagauccgggaggggcgcaucaucaaggagaucuuccccaccggccgggugaagcacacggaggagugcacgugcggguucgccuccaacaagaccaucgagugcgccugccgcgacaacagcuacaccgccaagcggcccuucgugaagcugaacgucgagaccgacaccgccgagauccgccugaugugcaccgagaccuaccucgacacgccgcggcccaacgacggcuccaucaccgggcccugcgagagcaacggcgacaagggcuccgggggcaucaagggcggguucgugcaccagcgcauggcgagcaagaucgggcggugguacucccgcaccaugagcaagaccaagcggaugggcaugggccuguacgugaaguacgacggggaccccuggacggacuccgaggcccuggcccucagcggcgucaugguguccauggaggagccggggugguacagcuucggcuucgagaucaaggacaagaagugcgacgugcccugcaucgggaucgagaugguccacgacggcggcaagaccaccuggcacuccgccgccaccgcgaucuacugccugauggggagcggccagcugcucugggacacggugaccggggugaacaugacccuguga

SEQ ID NO: 91429 - RNA, 1401 nt, Artificial Sequence; identical to SEQ ID NO: 91382
  derived and/or modified sequence opt1 from neuraminidase__InfluenzaB__AKU40662

SEQ ID NO: 91430 - RNA, 1401 nt, Artificial Sequence
  derived and/or modified sequence opt1 from neuraminidase__InfluenzaB__AKU40673
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagagcgaguggaccuacccgcgccuguccugccccgggagcaccuuccagaaggcccuccugaucagcccccaccgguucggcgagaccaaggggaacuccgcgccccugaucauccgcgagccguucaucgccugcggccccaaggagugcaagcacuucgcccucacccacuacgccgcgcagcccggcggguacuacaacggcacccgggaggaccgcaacaagcugcggcaccugaucuccgugaagcucgggaagauccccaccgucgagaacagcaucuuccacauggccgccugguccggcagcgccugccacgacgggcgcgaguggacguacaucggcguggacggcccggacuccaacgcccugcugaagaucaaguacggggaggcguacaccgacaccuaccacagcuacgccaagaacauccuccggacccaggagagcgccugcaacugcaucggcggggacugcuaccugaugaucacggacggccccgccuccggcaucagcgagugccgcuuccugaagauccgggaggggcgcaucaucaaggagaucuuccccaccggccgggugaagcacaccgaggagugcacgugcggguucgccuccaacaagaccaucgagugcgcgugccgcgacaacagcuacaccgccaagcggcccuucgucaagcucaacguggagaccgacaccgccgagauccgccugaugugcacgaagaccuaccuggacaccccgcggcccaacgacggcuccaucaccgggcccugcgagagcgacggcgacgagggcuccgggggcaucaagggcggguucgugcaccagcgcauggccagcaagaucgggcggugguacucccgcacgaugagcaagaccaagcggaugggcaugggccucuacgucaaguacgacggggaccccuggaccgacuccgaggcccuggcgcugagcggcgugaugguguccauggaggagccggggugguacagcuucggcuucgagaucaaggacaagaagugcgacguccccugcaucgggaucgagauggugcacgacggcggcaagaccacguggcacuccgccgccaccgccaucuacugccucauggggagcggccagcugcugugggacaccgugaccggggucaacaugacgcucuga

SEQ ID NO: 91431 - RNA, 1401 nt, Artificial Sequence; identical to SEQ ID NO: 91382
  derived and/or modified sequence opt1 from neuraminidase__InfluenzaB__AKU40684

SEQ ID NO: 91432 - RNA, 1401 nt, Artificial Sequence; identical to SEQ ID NO: 91382
  derived and/or modified sequence opt1 from neuraminidase__InfluenzaB__AKU40695

SEQ ID NO: 91433 - RNA, 1401 nt, Artificial Sequence; identical to SEQ ID NO: 91382
  derived and/or modified sequence opt1 from neuraminidase__InfluenzaB__AKU40706

SEQ ID NO: 91434 - RNA, 1401 nt, Artificial Sequence; identical to SEQ ID NO: 91382
  derived and/or modified sequence opt1 from neuraminidase__InfluenzaB__AKU40717

SEQ ID NO: 91435 - RNA, 1401 nt, Artificial Sequence
  derived and/or modified sequence opt1 from neuraminidase__InfluenzaB__AKU40728
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgcccaggccgugaaccgguccgccacgaagggcgucacgccccuccugcccgagccggaguggaccuacccccgccugagcugccccggguccaccuuccagaaggcgcuccugaucagcccccaccgguucggcgagaccaaggggaacuccgccccgcugaucauccgcgagcccuucaucgccugcggccccaaggagugcaagcacuucgcccucacccacuacgcggcccagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggccguucgugaagcucaacgucgagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgugaaguacgacggggacccguggaccgacagcgaggcgcuggcccuguccggcgucauggugagcauggaggagcccgggugguacuccuucggcuucgagaucaaggacaagaagugcgacgugcccugcaucgggaucgagaugguccacgacggcggcaagaccacguggcacagcgccgccaccgccaucuacugccucaugggguccggccagcugcugugggacaccgugaccggggugaacaugacgcucuga

SEQ ID NO: 91436 - RNA, 1401 nt, Artificial Sequence
  derived and/or modified sequence opt1 from neuraminidase__InfluenzaB__AKU40739
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggagaccuacaccgacaccuaccacuccuacgcgaagaacauccuccggacgcaggagagcgccugcaacugcaucggcggggacugcuaccugaugaucaccgacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggccguucgucaagcucaacguggagaccgacacggccgagauccgccugaugugcaccaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcccuguccggcgugauggugagcauggaggagcccgggugguacuccuucggcuucgagaucaaggacaagaagugcgacguccccugcaucgggaucgagauggugcacgacggcggcaagacgaccuggcacagcgcggccaccgccaucuacugccucaugggguccggccagcugcugugggacaccgugacgggggucaacaugacccucuga

SEQ ID NO: 91437 - RNA, 1401 nt, Artificial Sequence
  derived and/or modified sequence opt1 from neuraminidase__InfluenzaB__AKU40750
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugaucccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacgcacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggaccuacaucggcguggacggccccgacagcaacgcccugcugaagaucaaguacggggaggcguacacggacaccuaccacuccuacgccaagaacauccuccggacccaggagagcgccugcaacugcaucggcggggacugcuaccugaugaucaccgacggccccgccagcggcaucuccgagugccgcuuccugaagauccgggaggggcgcaucaucaaggagaucuuccccacgggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcaccaagacguaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccaccuggcacagcgccgccacggccaucuacugccucaugggguccggccagcugcugugggacaccgugaccggggucaacaugacccucuga

SEQ ID NO: 91438 - RNA, 1401 nt, Artificial Sequence; identical to SEQ ID NO: 91382
  derived and/or modified sequence opt1 from neuraminidase__InfluenzaB__AKU40761

SEQ ID NO: 91439 - RNA, 1401 nt, Artificial Sequence; identical to SEQ ID NO: 91382
  derived and/or modified sequence opt1 from neuraminidase__InfluenzaB__AKU40772

SEQ ID NO: 91440 - RNA, 1401 nt, Artificial Sequence; identical to SEQ ID NO: 91382
  derived and/or modified sequence opt1 from neuraminidase__InfluenzaB__AKU40783

SEQ ID NO: 91441 - RNA, 1401 nt, Artificial Sequence
  derived and/or modified sequence opt1 from neuraminidase__InfluenzaB__AKU40794
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacacgagcaacgugcaggccgucaaccgguccgccaccaagggcgugacgccccuccugcccgagccggaguggaccuacccccgccugagcugccccggguccaccuuccagaaggcccuccugaucagcccccaccgguucggcgagaccaaggggaaguccgccccgcugaucauccgcgagcccuucaucgcgugcggccccaaggagugcaagcacuucgcccucacccacuacgccgcccagcccggcggguacuacaacggcacccgggaggaccgcaacaagcugcggcaccugaucagcgugaagcucgggaagaucccgacggucgagaacuccaucuuccacauggcggccuggagcggcuccgccugccacgacgggcgcgaguggaccuacaucggcguggacggccccgacagcaacgcccugcugaagaucaaguacggggaggccuacaccgacaccuaccacuccuacgcgaagaacauccuccggacgcaggagagcgccugcaacugcaucggcggggacugcuaccugaugaucaccgacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgccugccgcgacaacuccuacaccgcgaagcggccguucgucaagcucaacguggagaccgacacggccgagauccgccugaugugcaccaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcccuguccggcgugauggugagcauggaggagcccgggugguacuccuucggcuucgagaucaaggacaagaagugcgacguccccugcaucgggaucgagauggugcacgacggcggcaagacgaccuggcacagcgcggccaccgccaucuacugccucaugggguccggccagcugcugugggacaccgugacgggggucaacaugacccucuga

SEQ ID NO: 91442 - RNA, 1401 nt, Artificial Sequence; identical to SEQ ID NO: 91382
  derived and/or modified sequence opt1 from neuraminidase__InfluenzaB__AKU40805

SEQ ID NO: 91443 - RNA, 1401 nt, Artificial Sequence; identical to SEQ ID NO: 91382
  derived and/or modified sequence opt1 from neuraminidase__InfluenzaB__AKU40816

SEQ ID NO: 91444 - RNA, 1401 nt, Artificial Sequence; identical to SEQ ID NO: 91382
  derived and/or modified sequence opt1 from neuraminidase__InfluenzaB__AKU40827

SEQ ID NO: 91445 - RNA, 1401 nt, Artificial Sequence; identical to SEQ ID NO: 91382
  derived and/or modified sequence opt1 from neuraminidase__InfluenzaB__AKU40838

SEQ ID NO: 91446 - RNA, 1401 nt, Artificial Sequence; identical to SEQ ID NO: 91382
  derived and/or modified sequence opt1 from neuraminidase__InfluenzaB__AKU40849

SEQ ID NO: 91447 - RNA, 1401 nt, Artificial Sequence; identical to SEQ ID NO: 91382
  derived and/or modified sequence opt1 from neuraminidase__InfluenzaB__AKU40860

SEQ ID NO: 91448 - RNA, 1401 nt, Artificial Sequence
  derived and/or modified sequence opt1 from neuraminidase__InfluenzaB__AKU40871
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcguggcgccccuccugcccgagccggaguggaccuacccccgccugagcugccccggguccaccuuccagaaggcccuccugaucagcccccaccgguucggcgagaccaaggggaacuccgccccgcugaucauccgcgagcccuucaucgccugcggccccaaggagugcaagcacuucgcccucacgcacuacgcggcccagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggaccuacaucggcguggacggccccgacagcaacgcgcugcugaagaucaaguacggggaggccuacacggacaccuaccacuccuacgccaagaacauccuccggacccaggagagcgccugcaacugcaucggcggggacugcuaccugaugaucaccgacggccccgccagcggcaucuccgagugccgcuuccugaagauccgggaggggcgcaucaucaaggagaucuuccccacgggccgggugaagcacaccgaggagugcacgugcggguucgcgagcaacaagaccaucgagugcgccugccgcgacaacuccuacaccgccaagcggccguucgucaagcucaacguggagaccgacaccgccgagauccgccugaugugcaccaagacguaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcgcugacccuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgccaucuacugccucaugggguccggccagcugcugugggacaccgugaccggggucaacaugacgcucuga

SEQ ID NO: 91449 - RNA, 1401 nt, Artificial Sequence; identical to SEQ ID NO: 91382
  derived and/or modified sequence opt1 from neuraminidase__InfluenzaB__AKU40882

SEQ ID NO: 91450 - RNA, 1401 nt, Artificial Sequence
  derived and/or modified sequence opt1 from neuraminidase__InfluenzaB__AKU40893
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaaccgguacaccgccaagcgccccuucgugaagcugaacguggagaccgacacggccgagauccggcugaugugcaccgacaccuaccucgacaccccgcgccccaacgacggguccaucacgggccccugcgagagcgacggcgacaagggguccggcgggaucaagggcggguucguccaccagcggaugaaguccaagaucggccgcugguacagccggaccaugagcaagaccgagcgcaugggcauggggcuguacgugaaguacgacggcgaccccugggccgacuccggggcccuggcguucagcggcgugauggucuccaugaaggagccggggugguacagcuucggcuucgagaucaaggacaagaagugcgacgugcccugcaucggcaucgagauggugcacgacgggggcaaggagaccuggcacuccgccgccacggccaucuacugccucauggggagcggccagcugcugugggacaccgucaccggcguggacauggcccucuga

SEQ ID NO: 91451 - RNA, 1401 nt, Artificial Sequence; identical to SEQ ID NO: 91382
  derived and/or modified sequence opt1 from neuraminidase__InfluenzaB__AKU40904

SEQ ID NO: 91452 - RNA, 1401 nt, Artificial Sequence
  derived and/or modified sequence opt1 from neuraminidase__InfluenzaB__AKU40915
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugcccauggaggagcccgggugguacagcuucggcuucgagaucaaggacaagaagugcgacguccccugcaucgggaucgagauggugcacgacggcggcaagaccacguggcacuccgccgccaccgccaucuacugccucauggggagcggccagcugcugugggacaccgugaccggggucaacaugacgcucuga

SEQ ID NO: 91453 - RNA, 1401 nt, Artificial Sequence; identical to SEQ ID NO: 91382
  derived and/or modified sequence opt1 from neuraminidase__InfluenzaB__AKU40926

SEQ ID NO: 91454 - RNA, 1401 nt, Artificial Sequence; identical to SEQ ID NO: 91436
  derived and/or modified sequence opt1 from neuraminidase__InfluenzaB__AKU40937

SEQ ID NO: 91455 - RNA, 1401 nt, Artificial Sequence; identical to SEQ ID NO: 91382
  derived and/or modified sequence opt1 from neuraminidase__InfluenzaB__AKU40948

SEQ ID NO: 91456 - RNA, 1401 nt, Artificial Sequence; identical to SEQ ID NO: 91382
  derived and/or modified sequence opt1 from neuraminidase__InfluenzaB__AKU40959

SEQ ID NO: 91457 - RNA, 1401 nt, Artificial Sequence; identical to SEQ ID NO: 91382
  derived and/or modified sequence opt1 from neuraminidase__InfluenzaB__AKU40970

SEQ ID NO: 91458 - RNA, 1401 nt, Artificial Sequence; identical to SEQ ID NO: 91382
  derived and/or modified sequence opt1 from neuraminidase__InfluenzaB__AKU40981

SEQ ID NO: 91459 - RNA, 1401 nt, Artificial Sequence; identical to SEQ ID NO: 91382
  derived and/or modified sequence opt1 from neuraminidase__InfluenzaB__AKU40991

SEQ ID NO: 91460 - RNA, 1401 nt, Artificial Sequence; identical to SEQ ID NO: 91382
  derived and/or modified sequence opt1 from neuraminidase__InfluenzaB__AKU41002

SEQ ID NO: 91461 - RNA, 1401 nt, Artificial Sequence; identical to SEQ ID NO: 91382
  derived and/or modified sequence opt1 from neuraminidase__InfluenzaB__AKU41013

SEQ ID NO: 91462 - RNA, 1401 nt, Artificial Sequence; identical to SEQ ID NO: 91382
  derived and/or modified sequence opt1 from neuraminidase__InfluenzaB__AKU41024

SEQ ID NO: 91463 - RNA, 1401 nt, Artificial Sequence; identical to SEQ ID NO: 89969
  derived and/or modified sequence opt1 from neuraminidase__InfluenzaB__EPI173278

SEQ ID NO: 91464 - RNA, 1401 nt, Artificial Sequence; identical to SEQ ID NO: 89969
  derived and/or modified sequence opt1 from neuraminidase__InfluenzaB__EPI498049

SEQ ID NO: 91465 - RNA, 1401 nt, Artificial Sequence; identical to SEQ ID NO: 89969
  derived and/or modified sequence opt1 from neuraminidase__InfluenzaB__AFH57913

SEQ ID NO: 91466 - RNA, 1401 nt, Artificial Sequence; identical to SEQ ID NO: 89969
  derived and/or modified sequence opt1 from neuraminidase__InfluenzaB__EPI827074

SEQ ID NO: 91467 - RNA, 1401 nt, Artificial Sequence; identical to SEQ ID NO: 89969
  derived and/or modified sequence opt1 from neuraminidase__InfluenzaB__EPI244698

SEQ ID NO: 91468 - RNA, 1401 nt, Artificial Sequence; identical to SEQ ID NO: 89969
  derived and/or modified sequence opt1 from neuraminidase__InfluenzaB__EPI244701

SEQ ID NO: 91469 - RNA, 1401 nt, Artificial Sequence; identical to SEQ ID NO: 91382
  derived and/or modified sequence opt1 from neuraminidase__InfluenzaB__EPI540672

SEQ ID NO: 91470 - RNA, 1401 nt, Artificial Sequence; identical to SEQ ID NO: 91382
  derived and/or modified sequence opt1 from neuraminidase__InfluenzaB__EPI829465

SEQ ID NO: 91471 - RNA, 1401 nt, Artificial Sequence
  derived and/or modified sequence opt1 from neuraminidase__InfluenzaB__EPI684428
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgacgaugccccuggacugcgcgaacgccagcaacgugcaggccgucaaccgguccaccaccaagggcgugacgccccucuuccccgagccggaguggaccuacccccgccugagcugccccggguccaccuuccagaaggcccugcucaucagcccccaccgguucggcgagaccaaggggaacuccgccccgcugaucauccgcgagcccuucaucgcgugcggccccaaggagugcaagcacuucgcccugacccacuacgccgcccagcccggcggguacuacaacggcacgcgggaggaccgcaacaagcuccggcaccugaucagcgugaagcuggggaagaucccgaccgucgagaacuccaucuuccacauggcggccuggagcggcuccgccugccacgacgggcgcgaguggaccuacaucggcguggacggccccgacagcaacgcccuccugaagaucaaguacggggaggccuacaccgacacguaccacuccuacgcgaagaacauccugcggacccaggagagcgccugcaacugcaucggcggggacugcuaccucaugaucaccgacggccccgccagcggcguguccgagugccgcuuccugaagauccgggaggggcgcaucaucaaggagaucuuccccaccggccgggucaagcacacggaggagugcacgugcggguucgccagcaacaagaccaucgagugcgccugccgcgacaaccgguacaccgcgaagcgcccguucgugaagcugaacguggagaccgacaccgccgagauccggcucaugugcaccaagaccuaccuggacacgccccgccccaacgacggcuccaucaccgggcccugcgagagcgacggcgacgagggcuccgggggcaucaagggcggguucguccaccagcggauggccagcaagaucgggcgcugguacucccggaccaugagcaagaccaagcgcaugggcaugggccuguacgugaaguacgacggggacccguggacggacuccgaggcccucgcccugagcggcgugauggucuccauggaggagcccgggugguacagcuucggcuucgagaucaaggacaagaagugcgacgugcccugcaucgggaucgagauggugcacgacggcggcaagaccaccuggcacuccgcggccaccgccaucuacugccugauggggagcggccagcuccugugggacacggucaccggggugaacaugacccuguga

SEQ ID NO: 91472 - RNA, 1401 nt, Artificial Sequence; identical to SEQ ID NO: 89991
  derived and/or modified sequence opt1 from neuraminidase__InfluenzaB__AFH58451

SEQ ID NO: 91473 - RNA, 1401 nt, Artificial Sequence; identical to SEQ ID NO: 89969
  derived and/or modified sequence opt1 from neuraminidase__InfluenzaB__EPI173280

SEQ ID NO: 91474 - RNA, 1401 nt, Artificial Sequence; identical to SEQ ID NO: 89969
  derived and/or modified sequence opt1 from neuraminidase__InfluenzaB__EPI186302

SEQ ID NO: 91475 - RNA, 1401 nt, Artificial Sequence
  derived and/or modified sequence opt1 from neuraminidase__InfluenzaB__EPI636339
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucguggccugcggccccaacgagugcaagcacuucgcccugacccacuacgccgcgcagcccggcggguacuacaacggcacccgcggggaccggaacaagcugcgccaccucaucagcgugaagcugggcaagaucccgacggucgagaacuccaucuuccacauggccgccuggagcggguccgccugccacgacggcaaggaguggaccuacaucggcguggacgggcccgacaacaacgcccugcucaaggugaaguacggcgaggcguacaccgacaccuaccacagcuacgccaacaacauccugcggacgcaggaguccgccugcaacugcaucgggggcaacugcuaccugaugaucaccgacggcagcgccagcggggucuccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaaccgguacaccgccaagcgccccuucgugaagcugaacgucgagaccgacacggccgagauccggcugaugugcaccgacaccuaccucgacaccccgcgccccaacgacggguccaucacgggccccugcgagagcgacggcgacaagggguccggcgggaucaagggcggguucgugcaccagcggaugaaguccaagaucggccgcugguacagccggaccaugagcaagaccgagcgcaugggcauggggcuguacgugaaguacggcggggaccccugggccgacuccgacgcccuggcguucagcggcgucaugguguccaugaaggagccggggugguacagcuucggcuucgagaucaaggacaagaagugcgacgugcccugcaucggcaucgagaugguccacgacgggggcaaggagaccuggcacuccgccgccacggccaucuacugccucauggggagcggccagcugcugugggacaccgugaccggcguggacauggcccucuga

SEQ ID NO: 91476 - RNA, 1401 nt, Artificial Sequence; identical to SEQ ID NO: 91475
  derived and/or modified sequence opt1 from neuraminidase__InfluenzaB__EPI645996

SEQ ID NO: 91477 - RNA, 1401 nt, Artificial Sequence
  derived and/or modified sequence opt1 from neuraminidase__InfluenzaB__EPI539770
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgcccaggccgugaaccgguccgccacgaagggcgucacgccccuccugcccgagccggaguggaccuacccccgccugagcugccccggguccaccuuccagaaggcgcuccugaucagcccccaccgguucggcgagaccaaggggaacuccgccccgcugaucauccgcgagcccuucaucgccugcggccccaaggagugcaagcacuucgcccucacccacuacgcggcccagcccggcggguacuacaacggcacccgggaggaccgcaacaagcugcggcaccugaucagcgugaagcucgggaagaucccgaccguggagaacuccaucuuccacauggccgccuggagcggcuccgccugccacgacgggcgcgaguggacguacaucggcgucgacggccccgacagcaacgcgcugcugaagaucaaguacggggaggccuacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgcgagcaacaagaccaucgagugcgccugccgcgacaacuccuacaccgccaagcggccguucgugaagcucaacgucgagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgugaaguacgacggggacccguggaccgacagcgaggcgcuggcccuguccggcgucauggugagcauggaggagcccgggugguacuccuucggcuucgagaucaaggacaagaagugcgacgugcccugcaucgggaucgagaugguccacgacggcggcaagaccacguggcacagcgccgccaccaccaucuacugccucaugggguccggccagcugcugugggacaccgugacgggggugaacaucacccucuga

SEQ ID NO: 91478 - RNA, 1401 nt, Artificial Sequence; identical to SEQ ID NO: 91477
  derived and/or modified sequence opt1 from neuraminidase__InfluenzaB__EPI551248

SEQ ID NO: 91479 - RNA, 1401 nt, Artificial Sequence; identical to SEQ ID NO: 91477
  derived and/or modified sequence opt1 from neuraminidase__InfluenzaB__EPI544258

SEQ ID NO: 91480 - RNA, 1401 nt, Artificial Sequence; identical to SEQ ID NO: 91382
  derived and/or modified sequence opt1 from neuraminidase__InfluenzaB__EPI592698

SEQ ID NO: 91481 - RNA, 1401 nt, Artificial Sequence; identical to SEQ ID NO: 91382
  derived and/or modified sequence opt1 from neuraminidase__InfluenzaB__EPI592706

SEQ ID NO: 91482 - RNA, 1401 nt, Artificial Sequence
  derived and/or modified sequence opt1 from neuraminidase__InfluenzaB__EPI693093
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggaguccaagaucgggcggugguacagccgcaccauguccaagaccaagcggaugggcaugggccucuacgucaaguacgacggggacccguggaccgacagcgaggcccuggcccuguccggcgugauggugagcauggaggagcccgggugguacuccuucggcuucgagaucaaggacaagaagugcgacguccccugcaucgggaucgagauggugcacgacggcggcaagaccacguggcacagcgcggccaccgccaucuacugccucaugggguccggccagcugcugugggacaccgugaccggggucaacaugacgcucuga

SEQ ID NO: 91483 - RNA, 1401 nt, Artificial Sequence
  derived and/or modified sequence opt1 from neuraminidase__InfluenzaB__EPI678795
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucaccuuccuccugcccgagccggaguggaccuacccccggcugagcugccccggguccacguuccagaaggcccuccugaucagcccccaccgcuucggcgagaccaaggggaacuccgcgccgcugaucauccgggagcccuucguggccugcggccccaacgagugcaagcacuucgcccucacccacuacgccgcgcagcccggcggguacuacaacggcacccgcggggaccggaacaagcugcgccaccugaucagcgugaagcucggcaagaucccgacggucgagaacuccaucuuccacauggccgccuggagcggguccgccugccacgacggcaaggaguggaccuacaucggcguggacgggcccgacaacaacgcccugcugaaggugaaguacggcgaggcguacaccgacaccuaccacagcuacgccaacaacauccuccggacgcaggaguccgccugcaacugcaucgggggcaacugcuaccugaugaucaccgacggcagcgccagcggggucuccgagugccgcuuccugaagauccgggagggccgcaucaucaaggagaucuuccccaccgggcgggugaagcacaccgaggagugcacgugcggcuucgccagcaacaagaccaucgagugcgcgugccgcgacaaccgguacaccgccaagcgccccuucgugaagcucaacgucgagaccgacacggccgagauccggcugaugugcaccgacaccuaccuggacaccccgcgccccaacgacggguccaucacgggccccugcgagagcgacggcgacaagggguccggcgggaucaagggcggguucgugcaccagcggaugaaguccaagaucggccgcugguacagccggaccaugagcaagaccgagcgcaugggcauggggcucuacgugaaguacggcgggaaccccugggccgacuccgacgcccugaccuucagcggcgucaugguguccaugaaggagccggggugguacagcuucggcuucgagaucaaggacaagaagugcgacgugcccugcaucggcaucgagaugguccacgacgggggcaaggagacguggcacuccgcggccaccgccaucuacugccugauggggagcggccagcuccugugggacaccgugaccggcguggacauggcccuguga

SEQ ID NO: 91484 - RNA, 1401 nt, Artificial Sequence; identical to SEQ ID NO: 91483
  derived and/or modified sequence opt1 from neuraminidase__InfluenzaB__EPI721063

SEQ ID NO: 91485 - RNA, 1401 nt, Artificial Sequence; identical to SEQ ID NO: 89903
  derived and/or modified sequence opt1 from neuraminidase__InfluenzaB__EPI328903

SEQ ID NO: 91486 - RNA, 1401 nt, Artificial Sequence
  derived and/or modified sequence opt1 from neuraminidase__InfluenzaB__EPI543192
augcugcccagcaccauccagacccucacgcuguuccugaccuccggcggggugcuccugagccuguacgucuccgccagccucuccuaccugcuguaccucgacauccugcugaaguucccgagcaccgagaucaccgcccccacgaugccccucgacugcgcgaacgccuccaacgugcaggccgugaaccgcagcgccaccaagggcgucacccugcugcuccccgagccggaguggaccuacccccggcuguccugccccgggagcacguuccagaaggcccugcucaucagcccccaccgcuucggcgagaccaaggggaacuccgcgccgcugaucauccgggagcccuucaucgccugcggccccaaggagugcaagcacuucgcccugacccacuacgccgcgcagcccggcggguacuacaacggcacccgcggggaccggaacaagcuccgccaccugaucuccgugaagcugggcaagaucccgacgguggagaacagcaucuuccacauggccgccugguccgggagcgccugccacgacggcaaggaguggaccuacaucggcgucgacgggcccgacaacaacgcccuccugaagaucaaguacggcgaggcguacaccgacaccuaccacuccuacgccaacaacauccugcggacgcaggagagcgccugcaacugcaucgggggcaacugcuaccucaugaucaccgacggcuccgccagcggggugagcgagugccgcuuccugaagauccgggagggccgcaucaugaaggagaucuuccccaccgggcggacccagcacacggaggagugcacgugcggcuucgccuccaacaagaccaucgagugcgcgugccgcgacaacagcuacaccgccaagcggcccuucgugaagcugaacgucgagaccgacaccgccgagauccgccucaugugcaccaagaccuaccuggacacgccgcggcccgacgacggguccaucaccggccccugcgagagcaacggcgggaagggcuccgggggcaucaagggcggguucgugcaccagcgcauggccagcaagaucggccggugguacucccgcaccaugagcaagaccgagcggaaggggaugggccuguacaucaaguacaacggggaccccugggccgacuccgacgcgcucacguucagcggcgugauggucuccauggaggagccggggugguacagcuucggcuucgagaucaaggacaagaagugcgacgugcccugcaucggcaucgagauggugcacgacgggggcaaggagaccuggcacuccgccgccaccgccaucuacugccugauggggagcggccagcugcucugggacaccgucacgggcgugaacaugacccuguga

SEQ ID NO: 91487 - RNA, 1401 nt, Artificial Sequence; identical to SEQ ID NO: 91486
  derived and/or modified sequence opt1 from neuraminidase__InfluenzaB__EPI500360

SEQ ID NO: 91488 - RNA, 1401 nt, Artificial Sequence
  derived and/or modified sequence opt1 from neuraminidase__InfluenzaB__EPI543186
augcugcccagcaccauccagacccucacgcuguuccugaccuccggcggggugcuccugagccuguacgucuccgccagccucuccuaccugcuguacagcgacauccuccugaaguucucccgcaccgaggugaccgccccgaucaugccccuggacugcgcgaacgccagcaacgugcaggccgucaaccgguccgccacgaagggcgugacgccccuccugcccgagccggaguggaccuacccccgccugagcugccccggguccaccuuccagaaggcccuccugaucagcccccaccgguucggcgagaccaaggggaacuccgcgccgcugaucauccgcgagcccuucaucgccugcggccccaaggagugcaagcacuucgcccucacccacuacgccgcgcagcccggcggguacuacaacggcacccgggaggaccgcaacaagcugcggcaccugaucagcgugaagcucgggaagaucccgaccgucgagaacuccaucuuccacauggccgccuggagcggcuccgccugccacgacgggcgcgaguggacguacaucggcguggacggccccgacagcaacgcccugcugaagaucaaguacggggaggcguacaccgacaccuaccacuccuacgccaagaacauccuccggacccaggagagcgccugcaacugcaucggcggggacugcuaccugaugaucacggacggccccgccagcggcaucuccgagugccgcuuccugaagauccgggaggggcgcaucaucaaggagaucuuccccaccggccgggugaagcacaccgaggagugcacgugcggguucgccagcaacaagaccaucgagugcgcgugccgcgacaacuccuacaccgccaagcggccguucgucaagcucaacguggagaccgacaccgccgagauccgccugaugugcacgaagaccuaccuggacacgccccggcccaacgacggcagcaucaccgggcccugcgaguccgacggcgacgagggcagcgggggcaucaagggcggguucgugcaccagcgcauggccuccaagaucgggcggugguacagccgcaccauguccaagaccaagcggaugggcaugggccucuacgucaaguacgacggggacccguggaccgacagcgaggcccuggcgcuguccggcgugauggugagcauggaggagcccgggugguacuccuucggcuucgagaucaaggacaagaagugcgacguccccugcaucgggaucgagauggugcacgacggcggcaagaccacguggcacagcgccgccaccgugaucuacugccucaugggguccggccagcugcugugggacaccgucaccggggugaacaugacgcucuga

SEQ ID NO: 91489 - RNA, 1401 nt, Artificial Sequence; identical to SEQ ID NO: 91488
  derived and/or modified sequence opt1 from neuraminidase__InfluenzaB__EPI536448

SEQ ID NO: 91490 - RNA, 1401 nt, Artificial Sequence
  derived and/or modified sequence opt1 from neuraminidase__InfluenzaB__NP_056663
augcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaaccacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuacaacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaaguggcugggcggcaucaagggcggguucgugcaccagcggauggccagcaagaucgggcgcugguacucccggaccaugagcaagaccaaccgcaugggcauggagcucuacgugaaguacgacggggaccccuggaccgacuccgacgcccugacccugagcggcgucaugguguccaucgaggagcccggcugguacagcuucggguucgagaucaaggacaagaagugcgacgugccgugcaucggcaucgagaugguccacgacgggggcaaggacaccuggcacuccgcggccaccgccaucuacugccucauggggagcggccagcugcugugggacacggugaccggcguggacauggcccucuga

SEQ ID NO: 91491 - RNA, 1401 nt, Artificial Sequence
  derived and/or modified sequence opt1 from neuraminidase__InfluenzaB__ABG85180
augcugcccagcaccgugcagacccucacgcugcugcucaccuccggcgggguccugcugagccucuacguguccgccagccuguccuaccugcucuacagcgacgugcugcugaaguucuccagcaccaagaccacggccccgaccaugucccucgagugcaccaacgcgagcaacgcccagaccgucaacuacuccgccacgaaggagaugaccuucccgccgcccgagcccgaguggaccuacccccgccugagcugccagggcuccaccuuccagaaggcccugcucaucagcccccaccgguucggggagaucaagggcaacuccgcgccccugaucauccgcgagcccuucguggccugcgggcccaaggagugccggcacuucgcccugacgcacuacgccgcccagcccggcggcuacuaccacgggacccgcaaggaccggaacaagcuccgccaccuggugagcgucaagcugggcaagauccccaccguggagaacuccaucuuccacauggcggccuggagcggguccgccugccacgacggccgggaguggaccuacaucgggguggacggcccggacaacgacgcccucgucaagaucaaguacggcgaggccuacacggacaccuaccacagcuacgcgcacaacauccugcgcacccaggagagcgccugcaacugcaucgggggcgacugcuaccugaugaucaccgacggguccgccagcggcaucuccaagugccgguuccucaagauccgcgagggccggaucaucaaggagauccugcccacggggcgcguggagcacaccgaggagugcacgugcggcuucgccagcaacaagaccaucgagugcgccugccgggacaacuccuacaccgcgaagcgccccuucgugaagcugaacgucgagaccgacaccgccgagauccggcucaugugcaccaagacguaccuggacacgccccgcccggacgacgggagcaucgccggccccugcgaguccaacggggacaagggccugggcgggaucaagggcggguucgugcaccagcggauggccuucaagaucggccgcugguacagccggaccauguccaagaccaaccgcauggggauggagcucuacgugaaguacgacggcgaccccuggaccgacagcgacgcccugacccuguccggcgucauggugagcaucgaggagcccgggugguacuccuucggcuucgagaucaaggacaagaagugcgacgugccgugcaucgggaucgagaugguccacgacggcggggaggacaccuggcacagcgcggccaccgccaucuacugccucaugggcuccggccagcugcugugggacacggugaccgggaucgacauggcccucuga

SEQ ID NO: 91492 - RNA, 1401 nt, Artificial Sequence; identical to SEQ ID NO: 91381
  derived and/or modified sequence opt1 from neuraminidase__InfluenzaB__EPI376345

SEQ ID NO: 91493 - RNA, 1401 nt, Artificial Sequence; identical to SEQ ID NO: 91381
  derived and/or modified sequence opt1 from neuraminidase__InfluenzaB__EPI368424

SEQ ID NO: 91494 - RNA, 1401 nt, Artificial Sequence
  derived and/or modified sequence opt1 from neuraminidase__InfluenzaB__EPI331150
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccaugaaccgcuccgccaccaagggcgugacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgucaagcugggcaagaucccgacgguggagaacuccaucuuccacauggccgccuggagcggguccgccugccacgacggcaaggaguggaccuacaucggcguggacgggcccgacaacaacgcccugcucaaggucaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggugaagcacaccgaggagugcacgugcggcuucgccagcaacaagaccaucgagugcgcgugccgcgacaacuccuacaccgccaagcggcccuucgucaagcugaacguggagaccgacacggccgagauccgccugaugugcaccgacaccuaccucgacaccccgcggcccaacgacgggagcaucacgggccccugcgaguccgacggcgacaaggggagcggcgggaucaagggcggguucgugcaccagcgcauggaguccaagaucggccggugguacagccgcaccauguccaagaccgagcggaugggcauggggcuguacgucaaguacgacggcgaccccugggccgacagcgacgcccuggcguucuccggggugauggugagcaugaaggagccgggcugguacuccuucggguucgagaucaaggacaagaagugcgacguccccugcaucggcaucgagauggugcacgacggcgggaaggagaccuggcacagcgccgccacggccaucuacugccucaugggcuccgggcagcugcugugggacaccgugaccggcgucgacauggcccucuga

SEQ ID NO: 91495 - RNA, 1401 nt, Artificial Sequence; identical to SEQ ID NO: 91494
  derived and/or modified sequence opt1 from neuraminidase__InfluenzaB__EPI358089

SEQ ID NO: 91496 - RNA, 1401 nt, Artificial Sequence; identical to SEQ ID NO: 89640
  derived and/or modified sequence opt1 from neuraminidase__InfluenzaB__ABL76698

SEQ ID NO: 91497 - RNA, 1401 nt, Artificial Sequence
  derived and/or modified sequence opt1 from neuraminidase__InfluenzaB__AAD42328
augcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcaugacccuccugcugcccgagccggaguggaccuacccccggcucagcugccccggguccacguuccagaaggcccugcugaucagcccccaccgcuucggcgagacccgggggaacuccgcgccgcucaccauccgcgagcccuucaucgccugcggccccaaggagugcaagcacuucgcccugacccacuacgccgcgcagcccggcggguacuacaacggcacgcgggaggaccgcaacaagcugcggcaccucaucagcgucaagcuggggaagaucccgaccguggagaacuccaucuuccacauggccgccuggagcggcuccgccugccacgacgggcgcgaguggaccuacaucggcguggacggccccgacagcaacgcccugaucaagaucaaguacggggaggcguacaccgacacguaccacuccuacgccaacaacauccuccggacccaggagagcgccugcaacugcaucggcggggacugcuaccugaugaucaccgacggcagcgccuccggcaucagcaagugccgcuuccugaagauccgggaggggcgcaucaucaaggagaucuuccccaccggccgggucgagcacacggaggagugcacgugcggguucgccuccaacaagaccaucgagugcgcgugccgcgacaacagcuacaccgccaagcggcccuucgugaagcucaacguggagaccgacaccgccgagauccgccugaugugcaccgagaccuaccuggacacgccgcggcccgacgacggcuccaucaccgggcccugcgagagcaacggcgacaagggccgcgggggcaucaagggcggguucguccaccagcggauggccuccaagaucgggcgcugguacagccggaccauguccaagaccaagcgcaugggcauggagcucuacgugaaguacgacggcgaccccuggaucgacagcgacgcccuggcgccguccggggugauggucagcauggaggagcccggcugguacuccuucggguucgagaucaaggacaagaagugcgacgugcccugcaucggcaucgagauggugcacgacgggggcaagaagacguggcacagcgccgccaccgccaucuacugccugaugggcuccgggcagcuccugugggacaccgucaccggcguggaccgcagcguguga

SEQ ID NO: 91498 - RNA, 1401 nt, Artificial Sequence; identical to SEQ ID NO: 91183
  derived and/or modified sequence opt1 from neuraminidase__InfluenzaB__EPI541349

SEQ ID NO: 91499 - RNA, 1401 nt, Artificial Sequence; identical to SEQ ID NO: 91382
  derived and/or modified sequence opt1 from neuraminidase__InfluenzaB__EPI541759

SEQ ID NO: 91500 - RNA, 1401 nt, Artificial Sequence; identical to SEQ ID NO: 91475
  derived and/or modified sequence opt1 from neuraminidase__InfluenzaB__EPI826201

SEQ ID NO: 91501 - RNA, 1401 nt, Artificial Sequence; identical to SEQ ID NO: 91214
  derived and/or modified sequence opt1 from neuraminidase__InfluenzaB__EPI477398

SEQ ID NO: 91502 - RNA, 1401 nt, Artificial Sequence; identical to SEQ ID NO: 91214
  derived and/or modified sequence opt1 from neuraminidase__InfluenzaB__EPI492570

SEQ ID NO: 91503 - RNA, 1401 nt, Artificial Sequence; identical to SEQ ID NO: 91214
  derived and/or modified sequence opt1 from neuraminidase__InfluenzaB__EPI498339

SEQ ID NO: 91504 - RNA, 1401 nt, Artificial Sequence; identical to SEQ ID NO: 91435
  derived and/or modified sequence opt1 from neuraminidase__InfluenzaB__EPI538118

SEQ ID NO: 91505 - RNA, 1401 nt, Artificial Sequence; identical to SEQ ID NO: 91435
  derived and/or modified sequence opt1 from neuraminidase__InfluenzaB__EPI538124

SEQ ID NO: 91506 - RNA, 1401 nt, Artificial Sequence; identical to SEQ ID NO: 91435
  derived and/or modified sequence opt1 from neuraminidase__InfluenzaB__EPI556421

SEQ ID NO: 91507 - RNA, 1401 nt, Artificial Sequence; identical to SEQ ID NO: 91435
  derived and/or modified sequence opt1 from neuraminidase__InfluenzaB__EPI614609

SEQ ID NO: 91508 - RNA, 1401 nt, Artificial Sequence; identical to SEQ ID NO: 89679
  derived and/or modified sequence opt1 from neuraminidase__InfluenzaB__BAB32609

SEQ ID NO: 91509 - RNA, 1401 nt, Artificial Sequence; identical to SEQ ID NO: 89825
  derived and/or modified sequence opt1 from neuraminidase__InfluenzaB__EPI271544

SEQ ID NO: 91510 - RNA, 1401 nt, Artificial Sequence; identical to SEQ ID NO: 89825
  derived and/or modified sequence opt1 from neuraminidase__InfluenzaB__AFH57957

SEQ ID NO: 91511 - RNA, 1401 nt, Artificial Sequence; identical to SEQ ID NO: 89825
  derived and/or modified sequence opt1 from neuraminidase__InfluenzaB__EPI294881

SEQ ID NO: 91512 - RNA, 1401 nt, Artificial Sequence; identical to SEQ ID NO: 89680
  derived and/or modified sequence opt1 from neuraminidase__InfluenzaB__ABL77259

SEQ ID NO: 91513 - RNA, 1701 nt, Artificial Sequence
  derived and/or modified sequence opt2 from hemagglutinin__InfluenzaA__AAA16879
auggaggccaagcucuucguccucuucugcaccuucaccguccucaaggccgacaccaucugcgucggcuaccacgccaacaacuccaccgacaccgucgacaccguccucgagaagaacgucaccgucacccacuccgucaaccuccucgaggacucccacaacggcaagcucugcucccucaacggcaucgccccccuccagcucggcaagugcaacgucgccggcuggcuccucggcaaccccgagugcgaccuccuccucaccgccaacuccugguccuacaucaucgagaccuccaacuccgagaacggcaccugcuaccccggcgaguucaucgacuacgaggagcuccgcgagcagcucuccuccgucuccuccuucgagaaguucgagaucuuccccaaggccuccuccuggcccaaccacgagaccaccaagggcgucaccgccgccugcuccuacuccggcgccuccuccuucuaccgcaaccuccucuggaucaccaagaagggcaccuccuaccccaagcucuccaaguccuacaccaacaacaagggcaaggagguccucguccucuggggcguccaccacccccccaccaccuccgagcagcagucccucuaccagaacgccgacgccuacgucuccgucggcuccuccaaguacaaccgccgcuucacccccgagaucgccgcccgccccaagguccgcggccaggccggccgcaugaacuacuacuggacccuccucgaccagggcgacaccaucaccuucgaggccaccggcaaccucaucgcccccugguacgccuucgcccucaacaagggcuccgacuccggcaucaucaccuccgacgcccccguccacaacugcgacacccgcugccagaccccccacggcgcccucaacuccucccuccccuuccagaacguccaccccaucaccaucggcgagugccccaaguacaucaaguccaccaagcuccgcauggccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaaccucgagcgccgcaucgagaaccucaacaagaaggucgacgacggcuuccucgacgucuggaccuacaacgccgagcuccucguccuccucgagaacgagcgcacccucgacuuccacgacuccaacguccgcaaccucuacgagaaggucaagucccagcuccgcaacaacgccaaggagcucggcaacggcugcuucgaguucuaccacaagugcgacgacgagugcauggagcgcgagaagaacggcaccuacgacuaccccaaguacuccgaggaguccaagcucaaccgcgaggagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91514 - RNA, 1701 nt, Artificial Sequence
  derived and/or modified sequence opt2 from hemagglutinin__InfluenzaA__AAA16880
auggaggccaagcucuucguccucuucugcaccuucaccguccucaaggccgacaccaucugcgucggcuaccacgccaacaacuccaccgacaccgucgacaccguccucgagaagaacgucaccgucacccacuccgucaaccuccucgaggacucccacaacggcaagcucugcucccucaacggcaucgccccccuccagcucggcaagugcaacgucgccggcuggcuccucggcaaccccgagugcgaccuccuccucaccgccaacuccugguccuacaucaucgagaccuccaacuccgagaacggcaccugcuaccccggcgaguucaucgacuacgaggagcuccgcgagcagcucuccuccgucuccuccuucgagaaguucgagaucuuccccaaggccuccuccuggcccaaccacgagaccaccaagggcgucaccgccgccugcuccuacuccggcgccuccuccuucuaccgcaaccuccucuggaucaccaagaagggcaccuccuaccccacccucuccaaguccuacaccaacaacaagggcaaggagguccucguccucuggggcguccaccacccccccaccgucaacgagcagcagucccucuaccagaacgccgacgccuacgucuccgucggcuccuccaaguacaaccgccgcuucacccccgagaucgccgcccgccccaagguccgcggccaggccggccgcaugaacuaccacuggacccuccucgaccagggcgacaccaucaccuucgaggccaccggcaaccucaucgcccccugguacgccuucgcccucaacaagggcuccgacuccggcaucaucaccuccgacgcccccguccacaacugcgacacccgcugccagaccccccacggcgcccucaacuccucccuccccuuccagaacguccaccccaucaccaucggcgagugccccaaguacgucaaguccaccaagcuccgcauggccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacaccaaguucaccgccgucggcaaggaguucaacaaccucgagcgccgcaucgagaaccucaacaagaaggucgacgacggcuuccucgacgucuggaccuacaacgccgagcuccucguccuccucgagaacgagcgcacccucgacuuccacgacuccaacguccgcaaccucuacgagaaggucaagucccagcuccgcaacaacgccaaggagcucggcaacggcugcuucgaguucuaccacaagugcgacgacgagugcaucgaguccgucaagaacggcaccuacgacuaccccaaguacuccgaggaguccaagcucaaccgcgaggagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91515 - RNA, 1689 nt, Artificial Sequence
  derived and/or modified sequence opt2 from hemagglutinin__InfluenzaA__AAA64362
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaaguaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccgacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugcccccgcuacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 91516 - RNA, 1689 nt, Artificial Sequence
  derived and/or modified sequence opt2 from hemagglutinin__InfluenzaA__AAA64363
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaucaacacccaguucgaggccgucgagaaggaguucuccaaccucgagcgccgccucgagaaccucaacaagaagauggaggacggcuuccucgacgucuggaccuacaacgccgagcuccucguccucauggagaacgagcgcacccucgacuuccacgacuccuccgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcaucuaccagauccucgccaucuacgccaccgucgccggcucccucucccucgccaucaugauggccggcaucuccuucuggaugugcuccaacggcucccuccagugccgcaucugcaucuga

SEQ ID NO: 91517 - RNA, 1689 nt, Artificial Sequence
  derived and/or modified sequence opt2 from hemagglutinin__InfluenzaA__AAA64365
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucgacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucgagaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacaacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcaucuaccagauccucgccaucuacgccaccgucgccggcucccucucccucgccaucaugauggccggcaucuccuucuggaugugcuccaacggcucccuccagugccgcaucugcaucuga

SEQ ID NO: 91518 - RNA, 1689 nt, Artificial Sequence
  derived and/or modified sequence opt2 from hemagglutinin__InfluenzaA__AAA64366
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaaggaguccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 91519 - RNA, 1701 nt, Artificial Sequence
  derived and/or modified sequence opt2 from hemagglutinin__InfluenzaA__AAA85781
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccaaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuacaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagauccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaaccccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91520 - RNA, 1707 nt, Artificial Sequence
  derived and/or modified sequence opt2 from hemagglutinin__InfluenzaA__AAC14418
auggagcgcaucguccuccuccucgccaccgucucccucgucaaguccgaccagaucugcaucggcuaccacgccaacaacuccaccgagcaggucgacaccaucauggagaagaacgucaccgucacccacgcccaggacauccucgagcgcacccacaacggcaagcucugcgaccucaacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcaacuucaacgacuacgaggagcucaagcaccuccucucccgcaucaaccacuucgagaagauccagaucauccccaaguccuccugguccaaccacgacgccuccuccggcgucuccuccgccugccccuaccucggccgcuccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucguccccgagaucgccacccgccccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgaccaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 91521 - RNA, 1707 nt, Artificial Sequence
  derived and/or modified sequence opt2 from hemagglutinin__InfluenzaA__AAC40508
auggagcgcaccguccuccuccucgccaccgucucccucgucaaguccgaccagaucugcaucggcuaccacgccaacaacuccaccgagcaggucgacaccaucauggagaagaacgucaccgucacccacgcccaggacauccucgagcgcacccacaacggcaagcucugcgaccucaacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcaacuucaacgacuacgaggagcucaagcaccuccucucccgcaucaaccacuucgagaagauccagaucauccccaaguccuccugguccaaccacgacgccuccuccggcgucuccuccgccugccccuaccucggccgcuccuccuucuuccgcaacgucgucuggcucaucaagaagaacuccgccuaccccaccaucaagcgcuccuacaacaacaccaaccaggaggaccuccucguccucuggggcguccaccaccccaacgacgccgccgagcagaccaagcucuaccagaaccccaccaccuacaucuccgucggcaccuccacccucaaccagcgccucguccccgagaucgccacccgccccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacaccccccagcgcgagcgccgccgcaagaagcgcggccucuucggcgccaucgccggcuucaucgagggcggcuggcagggcauggucgacggcugguacggcuaccaccacuccaacgagcagggcuccugcuacuccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 91522 - RNA, 1701 nt, Artificial Sequence
  derived and/or modified sequence opt2 from hemagglutinin__InfluenzaA__AAF87274
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcucaagggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccaacuccuggcccaaccacgagaccaaccgcggcgucaccuccgccugccccuacgccggcgccaacuccuucuaccgcaaccucaucuggcucgucaagaagggcaacuccuaccccaagcucuccaaguccuacaucaacaacaagggcaaggagguccucguccucuggggcauccaccacccccccaccuccaacgaccagcagucccucuaccagaacgccgacgccuacgucuucgucggcuccuccaaguacaacaagaaguucaugcccgagaucgccacccgccccaagguccgcggccaggccggccgcaugaacuacuacuggacccucaucgagcccggcgacaccaucaccuucgaggccaccggcaaccucgucgccccccgcuacgccuucgccauggagcgcggcuccggcuccggcaucaucaucuccgacacccccguccacgacugcaacgccaccugccagacccccaagggcgccaucaacaccaaccuccccuuccagaacauccaccccgucaccaucggcgagugccccaaguacgucaaguccacccgccuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucaagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcuccgcaacaacgccaaggagaucggcaacggcugcuucgaguucuaccacaagugcgacgacaccugcauggaguccaucaagaacggcaccuacgacuaccccaaguacuccgaggaggccaagcucacccgcgaggagaucgacggcgucaagcucgaguccacccgcaucuaccagauccucgccaucuacuccaccaucgccuccucccucguccuccucgucucccucggcgccaucuccuucuggaugugcuccaacggcucccuccagugccgcaucugcaucuga

SEQ ID NO: 91523 - RNA, 1701 nt, Artificial Sequence
  derived and/or modified sequence opt2 from hemagglutinin__InfluenzaA__AAF87275
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcucaagggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccaacuccuggcccaaccacgagaccaaccgcggcgucaccuccgccugccccuacgccggcgccaacuccuucuaccgcaaccucaucuggcucgucaagaagggcaacuccuaccccaagcucuccaaguccuacaucaacaacaagggcaaggagguccucguccucuggggcauccaccacccccccaccuccaacgaccagcagucccucuaccagaacgccgacgccuacgucuucgucggcuccuccaaguacaacaagaaguucaugcccgagaucgccacccgccccaagguccgcggccaggccggccgcaugaacuacuacuggacccucaucgagcccggcgacaccaucaccuucgaggccaccggcaaccucgucgccccccgcuacgccuucgccauggagcgcggcuccggcuccggcaucaucaucuccgacacccccguccacgacugcaacgccaccugccagacccccaagggcgccaucaacaccaaccuccccuuccagaacauccaccccgucaccaucggcgagugccccaaguacgucaaguccacccgccuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcuccgcaacaacgccaaggagaucggcaacggcugcuucgaguucuaccacaagugcgacgacaccugcauggaguccaucaagaacggcaccuacgacuaccccaaguacuccgaggaggccaagcucacccgcgaggagaucgacggcgucaagcucgaguccacccgcaucuaccagauccucgccaucuacuccaccaucgccuccucccucguccuccucgucucccucggcgccaucuccuucuggaugugcuccaacggcucccuccagugccgcaucugcaucuga

SEQ ID NO: 91524 - RNA, 1701 nt, Artificial Sequence
  derived and/or modified sequence opt2 from hemagglutinin__InfluenzaA__AAF87277
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcaucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccgaccacgagaccaaccgcggcgucaccgccgccugccccuacgccggcgccaacuccuucuaccgcaaccucaucuggcucgucaagaagggcaacuccuaccccaagcucuccaaguccuacaucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccucccgccccaagguccgcggccaggccggccgcauggacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcgucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucauccuccucgucucccucggcgccaucuccuucuggaugugcuccaacggcucccuccagugccgcaucugcaucuga

SEQ ID NO: 91525 - RNA, 1701 nt, Artificial Sequence
  derived and/or modified sequence opt2 from hemagglutinin__InfluenzaA__AAF87278
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcaucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacaucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccucccgccccaagguccgcggccaggccggccgcauggacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcgucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcgcccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucauccuccucgucucccucggcgccaucuccuucuggaugugcuccaacggcucccuccagugccgcaucugcaucuga

SEQ ID NO: 91526 - RNA, 1701 nt, Artificial Sequence
  derived and/or modified sequence opt2 from hemagglutinin__InfluenzaA__AAF87279
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcaucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacaucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccucccgccccaagguccgcggccaggccggccgcauggacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcgucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucauccuccucgucucccucggcgccaucuccuucuggaugugcuccaacggcucccuccagugccgcaucugcaucuga

SEQ ID NO: 91527 - RNA, 1701 nt, Artificial Sequence
  derived and/or modified sequence opt2 from hemagglutinin__InfluenzaA__AAF87281
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucaagggcaucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccuccgccugccccuacgccggcgccaacuccuucuaccgcaaccucaucuggcucgucaagaagggcaacuccuaccccaagcucuccaaguccuacaucaacaacaagggcaagaagguccucguccucuggggcauccaccacccccccaccuccaccgaccagcagucccucuaccagaacgccgacgccuacgucuucgucggcuccuccaaguacaacaagaaguucaugcccgagaucgccacccgccccaagguccgcggccaggccggccgcaugaacuacuacuggacccucaucgagcccggcgacaccaucaccuucgaggccaccggcaaccucgucgucccccgcuacgccuucgccauggagcgcggcuacggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccaucgccuccucccucguccuccucgucucccucggcgccaucuccuucuggaugugcuccaacggcucccuccagugccgcaucugcaucuga

SEQ ID NO: 91528 - RNA, 1701 nt, Artificial Sequence; identical to SEQ ID NO: 91526
  derived and/or modified sequence opt2 from hemagglutinin__InfluenzaA__AAF87282

SEQ ID NO: 91529 - RNA, 1701 nt, Artificial Sequence
  derived and/or modified sequence opt2 from hemagglutinin__InfluenzaA__AAF87283
augaaggccauccucgucguccuccucuacgccuucaccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucaagggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccuccgccugccccuacuccggcgccaacuccuucuaccgcaaccucaucuggcucgucaagaagggcaacuccuaccccaagcucuccaaguccuacaucaacaacaagggcaaggagguccucguccucuggggcauccaccacccccccaccuccaccgaccagcagucccucuaccagaacgccgacgccuacgucuucgucggcuccuccaaguacaacaagaaguucaugcccgagaucgccacccgccccaagguccgcggccaggccggccgcaugaacuacuacuggacccucaucgagcccggcgacaccaucaccuucgaggccaccggcaaccucgucgccccccgcuacgccuucgccauggagcgcggcuccggcuccggcaucaucaucuccgacacccccgucuacgacugcaacaccgccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgcccccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucaacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggcccgccucaaccgcgaggagaucgacggcgucaagcucgaguccacccgcaucuaccagauccucgccaucuacuccaccaucgccuccucccucguccuccucgucucccucggcgccaucuccuucuggaugugcuccaacggcucccuccagugccgcaucugcaucuga

SEQ ID NO: 91530 - RNA, 1701 nt, Artificial Sequence
  derived and/or modified sequence opt2 from hemagglutinin__InfluenzaA__AAF87284
augaaggccauccucgucguccuccucuacgccuucaccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucaagggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccuccgccugccuccucuucugguccaagcagcuccuccagaagcucaacauggccggcaagaagggcaacuccuaccccaagcucuccaaguccuacaucaacaacaagggcaaggagguccucguccucuggggcauccaccacccccccaccuccaccgaccagcagucccucuaccagaacgccgacgccuacgucuucgucggcuccuccaaguacaacaagaaguucaugcccgagaucgccacccgccccaagguccgcggccaggccggccgcaugaacuacuacuggacccucaucgagcccggcgacaccaucaccuucgaggccaccggcaaccucgucgccccccgcuacgccuucgccauggagcgcggcuccggcuccggcaucaucaucuccgacacccccgucuacgacugcaacaccgccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucaacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggcccgccucaaccgcgaggagaucgacggcgucaagcucgaguccacccgcaucuaccagauccucgccaucuacuccaccaucgccuccucccucguccuccucgucucccucggcgccaucuccuucuggaugugcuccaacggcucccuccagugccgcaucugcaucuga

SEQ ID NO: 91531 - RNA, 1701 nt, Artificial Sequence
  derived and/or modified sequence opt2 from hemagglutinin__InfluenzaA__AAG01749
auguccaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgagaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91532 - RNA, 1701 nt, Artificial Sequence
  derived and/or modified sequence opt2 from hemagglutinin__InfluenzaA__AAG01767
augaacaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucaucgagcgcuccaaggccuacuccaacugcuaccccuacgacguccccgacuacuccucccuccgcucccucgucgccuccuccggcacccucgaguucaccaacgaggacuucaacuggaccggcgucgcccaggacggcggcuccuacuccugcaagcgcgaguccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgagcagaccucccucuacguccaggccaucggccgcgucaccgucuccaccaaguccucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucgacaacugcuacuccgagugcaucacccccaacggcuccauccccaacgacaagcccuuccagaacgucaaccgcaucaccuacggcgccugccccaaguacgucaagcagaagacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccaggucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91533 - RNA, 1701 nt, Artificial Sequence
  derived and/or modified sequence opt2 from hemagglutinin__InfluenzaA__AAG01776
augaacaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucaucgagcgcuccaaggccuacuccaacugcuaccccuacgacguccccgacuacuccucccuccgcucccucgucgccuccuccggcacccucgaguucaccaacgaggacuucaacuggaccggcgucgcccaggacggcggcuccuacuccugcaagcgcgaguccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgagcagaccucccucuacguccaggccaucggccgcgucaccgucuccaccaaguccucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucgacaacugcuacuccgagugcaucacccccaacggcuccauccccaacgacaagcccuuccagaacgucaaccgcaucaccuacggcgccugccccaaguacgucaagcagaagacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccaggucaacggcaagcucaacuggcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91534 - RNA, 1701 nt, Artificial Sequence
  derived and/or modified sequence opt2 from hemagglutinin__InfluenzaA__AAG01785
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucaucgagcgcuccaaggccuacuccaacugcuaccccuacgacguccccgacuacuccucccuccgcucccucgucgccuccuccggcacccucgaguucaccaacgaggacuucaacuggaccggcgucgcccaggacggcggcuccuacuccugcaagcgcgaguccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgagcagaccucccucuacguccaggccaucggccgcgucaccgucuccaccaaguccucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucgacaacugcuacuccgagugcaucacccccaacggcuccauccccaacgacaagcccuuccagaacgucaaccgcaucaccuacggcgccugccccaaguacgucaagcagaagacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccaggucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91535 - RNA, 1701 nt, Artificial Sequence
  derived and/or modified sequence opt2 from hemagglutinin__InfluenzaA__AAK52911
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91536 - RNA, 1701 nt, Artificial Sequence
  derived and/or modified sequence opt2 from hemagglutinin__InfluenzaA__AAK52912
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcaccaaggccuacuccaacugcuaccccuacgacguccccgacuacgccucccuccgcucccucgucgccuccuccggcacccucgaguucaccaacgagggcuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91537 - RNA, 1701 nt, Artificial Sequence
  derived and/or modified sequence opt2 from hemagglutinin__InfluenzaA__AAK71687
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagucccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccgagaccuccuccuggcccaaccacgacaccaaccgcggcgucaccgccgccugcccccacgccggcgccaacuccuucuaccgcaaccucaucuggcucgccaagaagggcgacuccuaccccaagcucuccaaguccuacaucaacaacaagggcaaggagguccucguccucuggggcauccaccacccccccaccuccgccgaccagcagucccucuaccagaacgccgacgccuacgucuucgucggcuccucccgcuacuccaagaaguucaagcccgagaucgccacccgccccaagguccgcggccaggccggccgcaugaacuacuacuggacccucgucgagcccggcgacaagaucaccuucgaggccaccggcaaccucgucgucccccgcuacgccuucgccaugaagcgcaacuccgaguccggcaucaucaucuccgacaucuccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgucgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcaccaucuccuucuggaugugcuccaacggcucccuccagugccgcaucugcaucuga

SEQ ID NO: 91538 - RNA, 1707 nt, Artificial Sequence
  derived and/or modified sequence opt2 from hemagglutinin__InfluenzaA__AAS65618
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggucucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgccaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcucaaggacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 91539 - RNA, 1704 nt, Artificial Sequence
  derived and/or modified sequence opt2 from hemagglutinin__InfluenzaA__AAT38819
augaacacccagauccucgccuucaucgccugcaugcucaucggcaccaagggcgacaagaucugccucggccaccacgccgucgccaacggcaccaaggucaacacccucaccgagcgcggcaucgaggucgucaacgccaccgagaccgucgagaccgucaacaucaagaagaucugcacccagggcaagcgccccaccgaccucggccagugcggccuccucggcacccucaucggccccccccagugcgaccaguuccucgaguucgacgccaaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgccaccuccgccugccgccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcgagucccucggcguccaguccgacgucccccucgacuccggcugcgagggcgacugcuuccacuccggcggcaccaucgucuccucccuccccuuccagaacaucaacccccgcaccgucggcaagugcccccgcuacgucaagcagaccucccuccuccucgccaccggcaugcgcaacguccccgagaaccccaagcaggccuaccagaagcagaugacccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgacaagaccaaccagcaguucgagcucaucgacaacgaguucuccgagaucgagcagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcgcugcaccaucugcaucuga

SEQ ID NO: 91540 - RNA, 1707 nt, Artificial Sequence
  derived and/or modified sequence opt2 from hemagglutinin__InfluenzaA__AAV32636
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 91541 - RNA, 1707 nt, Artificial Sequence; identical to SEQ ID NO: 91540
  derived and/or modified sequence opt2 from hemagglutinin__InfluenzaA__AAV34704

SEQ ID NO: 91542 - RNA, 1707 nt, Artificial Sequence
  derived and/or modified sequence opt2 from hemagglutinin__InfluenzaA__AAV65826
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucggcggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 91543 - RNA, 1701 nt, Artificial Sequence
  derived and/or modified sequence opt2 from hemagglutinin__InfluenzaA__AAX11505
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91544 - RNA, 1701 nt, Artificial Sequence
  derived and/or modified sequence opt2 from hemagglutinin__InfluenzaA__AAX11525
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91545 - RNA, 1701 nt, Artificial Sequence; identical to SEQ ID NO: 91544
  derived and/or modified sequence opt2 from hemagglutinin__InfluenzaA__AAX11535

SEQ ID NO: 91546 - RNA, 1701 nt, Artificial Sequence; identical to SEQ ID NO: 91544
  derived and/or modified sequence opt2 from hemagglutinin__InfluenzaA__AAX11545

SEQ ID NO: 91547 - RNA, 1701 nt, Artificial Sequence; identical to SEQ ID NO: 91543
  derived and/or modified sequence opt2 from hemagglutinin__InfluenzaA__AAX11555

SEQ ID NO: 91548 - RNA, 1701 nt, Artificial Sequence; identical to SEQ ID NO: 91544
  derived and/or modified sequence opt2 from hemagglutinin__InfluenzaA__AAX11565

SEQ ID NO: 91549 - RNA, 1701 nt, Artificial Sequence
  derived and/or modified sequence opt2 from hemagglutinin__InfluenzaA__AAX11585
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91550 - RNA, 1701 nt, Artificial Sequence; identical to SEQ ID NO: 91544
  derived and/or modified sequence opt2 from hemagglutinin__InfluenzaA__AAX11605

SEQ ID NO: 91551 - RNA, 1701 nt, Artificial Sequence; identical to SEQ ID NO: 91544
  derived and/or modified sequence opt2 from hemagglutinin__InfluenzaA__AAX11615

SEQ ID NO: 91552 - RNA, 1701 nt, Artificial Sequence
  derived and/or modified sequence opt2 from hemagglutinin__InfluenzaA__AAX11625
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcaggcccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91553 - RNA, 1701 nt, Artificial Sequence; identical to SEQ ID NO: 91544
  derived and/or modified sequence opt2 from hemagglutinin__InfluenzaA__AAX12731

SEQ ID NO: 91554 - RNA, 1701 nt, Artificial Sequence
  derived and/or modified sequence opt2 from hemagglutinin__InfluenzaA__AAX12741
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 91555 - RNA, 1701 nt, Artificial Sequence; identical to SEQ ID NO: 91544
  derived and/or modified sequence opt2 from hemagglutinin__InfluenzaA__AAX12751

SEQ ID NO: 91556 - RNA, 1701 nt, Artificial Sequence
  derived and/or modified sequence opt2 from hemagglutinin__InfluenzaA__AAX12761
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91557 - RNA, 1701 nt, Artificial Sequence
  derived and/or modified sequence opt2 from hemagglutinin__InfluenzaA__AAX12791
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggccucugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91558 - RNA, 1701 nt, Artificial Sequence
  derived and/or modified sequence opt2 from hemagglutinin__InfluenzaA__AAX12801
augaagaccaucaucgcccucuccuacauccucugccucgucuucgcccagaaguuccccggcaacgacaacuccaccgccacccucugccucggccaccacgccguccccaacggcacccucgucaagaccaucaccaacgaccagaucgaggucaccaacgccaccgagcucguccaguccuccuccaccgaccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91559 - RNA, 1701 nt, Artificial Sequence
  derived and/or modified sequence opt2 from hemagglutinin__InfluenzaA__AAX12811
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91560 - RNA, 1701 nt, Artificial Sequence
  derived and/or modified sequence opt2 from hemagglutinin__InfluenzaA__AAX34061
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91561 - RNA, 1701 nt, Artificial Sequence
  derived and/or modified sequence opt2 from hemagglutinin__InfluenzaA__AAX35821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91562 - RNA, 1701 nt, Artificial Sequence; identical to SEQ ID NO: 91543
  derived and/or modified sequence opt2 from hemagglutinin__InfluenzaA__AAX35831

SEQ ID NO: 91563 - RNA, 1701 nt, Artificial Sequence
  derived and/or modified sequence opt2 from hemagglutinin__InfluenzaA__AAX35851
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91564 - RNA, 1701 nt, Artificial Sequence
  derived and/or modified sequence opt2 from hemagglutinin__InfluenzaA__AAX35861
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91565 - RNA, 1701 nt, Artificial Sequence
  derived and/or modified sequence opt2 from hemagglutinin__InfluenzaA__AAX35871
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccgccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuucgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91566 - RNA, 1701 nt, Artificial Sequence; identical to SEQ ID NO: 91559
  derived and/or modified sequence opt2 from hemagglutinin__InfluenzaA__AAX38237

SEQ ID NO: 91567 - RNA, 1701 nt, Artificial Sequence
  derived and/or modified sequence opt2 from hemagglutinin__InfluenzaA__AAX47515
augaaggccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91568 - RNA, 1701 nt, Artificial Sequence
  derived and/or modified sequence opt2 from hemagglutinin__InfluenzaA__AAX47525
augaagaccaucaucgcccucuccuacauccucugccucgucuucgcccagaagcuccccggcaacgacaacuccaccgccacccucugcaugggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccgacaccgacuccaaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91569 - RNA, 1701 nt, Artificial Sequence; identical to SEQ ID NO: 91559
  derived and/or modified sequence opt2 from hemagglutinin__InfluenzaA__AAX47535

SEQ ID NO: 91570 - RNA, 1701 nt, Artificial Sequence; identical to SEQ ID NO: 91543
  derived and/or modified sequence opt2 from hemagglutinin__InfluenzaA__AAX56380

SEQ ID NO: 91571 - RNA, 1701 nt, Artificial Sequence; identical to SEQ ID NO: 91543
  derived and/or modified sequence opt2 from hemagglutinin__InfluenzaA__AAX56390

SEQ ID NO: 91572 - RNA, 1701 nt, Artificial Sequence
  derived and/or modified sequence opt2 from hemagglutinin__InfluenzaA__AAX56400
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91573 - RNA, 1701 nt, Artificial Sequence; identical to SEQ ID NO: 91543
  derived and/or modified sequence opt2 from hemagglutinin__InfluenzaA__AAX56410

SEQ ID NO: 91574 - RNA, 1701 nt, Artificial Sequence
  derived and/or modified sequence opt2 from hemagglutinin__InfluenzaA__AAX56420
augaagaccaucaucgcccucuccuacuuccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91575 - RNA, 1701 nt, Artificial Sequence
  derived and/or modified sequence opt2 from hemagglutinin__InfluenzaA__AAX56430
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91576 - RNA, 1701 nt, Artificial Sequence
  derived and/or modified sequence opt2 from hemagglutinin__InfluenzaA__AAX56440
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacaacgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91577 - RNA, 1701 nt, Artificial Sequence; identical to SEQ ID NO: 91559
  derived and/or modified sequence opt2 from hemagglutinin__InfluenzaA__AAX56450

SEQ ID NO: 91578 - RNA, 1701 nt, Artificial Sequence
  derived and/or modified sequence opt2 from hemagglutinin__InfluenzaA__AAX56460
augaagaccaucaucgcccucuccuacauccucugccucgucuucgcccagaagcuccccgagaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucacccacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91579 - RNA, 1701 nt, Artificial Sequence
  derived and/or modified sequence opt2 from hemagglutinin__InfluenzaA__AAX56470
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagaugcgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91580 - RNA, 1701 nt, Artificial Sequence; identical to SEQ ID NO: 91563
  derived and/or modified sequence opt2 from hemagglutinin__InfluenzaA__AAX56480

SEQ ID NO: 91581 - RNA, 1701 nt, Artificial Sequence
  derived and/or modified sequence opt2 from hemagglutinin__InfluenzaA__AAX56510
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91582 - RNA, 1701 nt, Artificial Sequence; identical to SEQ ID NO: 91559
  derived and/or modified sequence opt2 from hemagglutinin__InfluenzaA__AAX56520

SEQ ID NO: 91583 - RNA, 1701 nt, Artificial Sequence
  derived and/or modified sequence opt2 from hemagglutinin__InfluenzaA__AAX56530
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91584 - RNA, 1701 nt, Artificial Sequence
  derived and/or modified sequence opt2 from hemagglutinin__InfluenzaA__AAX56550
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91585 - RNA, 1701 nt, Artificial Sequence
  derived and/or modified sequence opt2 from hemagglutinin__InfluenzaA__AAX56560
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91586 - RNA, 1701 nt, Artificial Sequence
  derived and/or modified sequence opt2 from hemagglutinin__InfluenzaA__AAX56570
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91587 - RNA, 1701 nt, Artificial Sequence
  derived and/or modified sequence opt2 from hemagglutinin__InfluenzaA__AAX56590
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91588 - RNA, 1701 nt, Artificial Sequence; identical to SEQ ID NO: 91585
  derived and/or modified sequence opt2 from hemagglutinin__InfluenzaA__AAX56600

SEQ ID NO: 91589 - RNA, 1701 nt, Artificial Sequence
  derived and/or modified sequence opt2 from hemagglutinin__InfluenzaA__AAX57644
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccgucgucaagcccggcgacauccuccucaucaacuccaccggcaaccucaucgccccccgcggcuacuucaagaugcgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91590 - RNA, 1701 nt, Artificial Sequence; identical to SEQ ID NO: 91543
  derived and/or modified sequence opt2 from hemagglutinin__InfluenzaA__AAX57654

SEQ ID NO: 91591 - RNA, 1701 nt, Artificial Sequence; identical to SEQ ID NO: 91559
  derived and/or modified sequence opt2 from hemagglutinin__InfluenzaA__AAX57664

SEQ ID NO: 91592 - RNA, 1701 nt, Artificial Sequence
  derived and/or modified sequence opt2 from hemagglutinin__InfluenzaA__AAX57684
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91593 - RNA, 1701 nt, Artificial Sequence; identical to SEQ ID NO: 91563
  derived and/or modified sequence opt2 from hemagglutinin__InfluenzaA__AAX57694

SEQ ID NO: 91594 - RNA, 1701 nt, Artificial Sequence; identical to SEQ ID NO: 91585
  derived and/or modified sequence opt2 from hemagglutinin__InfluenzaA__AAX57704

SEQ ID NO: 91595 - RNA, 1701 nt, Artificial Sequence; identical to SEQ ID NO: 91563
  derived and/or modified sequence opt2 from hemagglutinin__InfluenzaA__AAX57714

SEQ ID NO: 91596 - RNA, 1701 nt, Artificial Sequence; identical to SEQ ID NO: 91592
  derived and/or modified sequence opt2 from hemagglutinin__InfluenzaA__AAX57733

SEQ ID NO: 91597 - RNA, 1701 nt, Artificial Sequence
  derived and/or modified sequence opt2 from hemagglutinin__InfluenzaA__AAX57734
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcaacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91598 - RNA, 1701 nt, Artificial Sequence; identical to SEQ ID NO: 91584
  derived and/or modified sequence opt2 from hemagglutinin__InfluenzaA__AAX57744

SEQ ID NO: 91599 - RNA, 1701 nt, Artificial Sequence; identical to SEQ ID NO: 91584
  derived and/or modified sequence opt2 from hemagglutinin__InfluenzaA__AAX57764

SEQ ID NO: 91600 - RNA, 1701 nt, Artificial Sequence; identical to SEQ ID NO: 91584
  derived and/or modified sequence opt2 from hemagglutinin__InfluenzaA__AAX57774

SEQ ID NO: 91601 - RNA, 1701 nt, Artificial Sequence
  derived and/or modified sequence opt2 from hemagglutinin__InfluenzaA__AAX57784
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91602 - RNA, 1701 nt, Artificial Sequence
  derived and/or modified sequence opt2 from hemagglutinin__InfluenzaA__AAX57794
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccauccacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91603 - RNA, 1701 nt, Artificial Sequence; identical to SEQ ID NO: 91584
  derived and/or modified sequence opt2 from hemagglutinin__InfluenzaA__AAX57814

SEQ ID NO: 91604 - RNA, 1701 nt, Artificial Sequence
  derived and/or modified sequence opt2 from hemagglutinin__InfluenzaA__AAX57824
augaagaccaucaucgcccucuccuacauccucugcauggucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91605 - RNA, 1701 nt, Artificial Sequence; identical to SEQ ID NO: 91584
  derived and/or modified sequence opt2 from hemagglutinin__InfluenzaA__AAX57834

SEQ ID NO: 91606 - RNA, 1701 nt, Artificial Sequence; identical to SEQ ID NO: 91584
  derived and/or modified sequence opt2 from hemagglutinin__InfluenzaA__AAX57844

SEQ ID NO: 91607 - RNA, 1701 nt, Artificial Sequence
  derived and/or modified sequence opt2 from hemagglutinin__InfluenzaA__AAX57864
augaagaccaucaucgcccucuccuacuuccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91608 - RNA, 1701 nt, Artificial Sequence; identical to SEQ ID NO: 91584
  derived and/or modified sequence opt2 from hemagglutinin__InfluenzaA__AAX57874

SEQ ID NO: 91609 - RNA, 1701 nt, Artificial Sequence; identical to SEQ ID NO: 91584
  derived and/or modified sequence opt2 from hemagglutinin__InfluenzaA__AAX57884

SEQ ID NO: 91610 - RNA, 1701 nt, Artificial Sequence
  derived and/or modified sequence opt2 from hemagglutinin__InfluenzaA__AAX57894
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagguccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91611 - RNA, 1701 nt, Artificial Sequence
  derived and/or modified sequence opt2 from hemagglutinin__InfluenzaA__AAX57924
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91612 - RNA, 1701 nt, Artificial Sequence; identical to SEQ ID NO: 91584
  derived and/or modified sequence opt2 from hemagglutinin__InfluenzaA__AAX57934

SEQ ID NO: 91613 - RNA, 1701 nt, Artificial Sequence
  derived and/or modified sequence opt2 from hemagglutinin__InfluenzaA__AAX57944
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91614 - RNA, 1701 nt, Artificial Sequence
  derived and/or modified sequence opt2 from hemagglutinin__InfluenzaA__AAX76623
augaagaccaucaucgcccucuccuacauccucugccucgucuucgcccagaagcuccccggcaacgacaaguccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcuccgcuccggcuacaaggacuggauccucuggaucuccuucgccaucuccugcuuccuccucugcgucgccucccucggcuucaucaugugggccugccagaagggcaacauccgcugcaacaucugcaucuga

SEQ ID NO: 91615 - RNA, 1701 nt, Artificial Sequence
  derived and/or modified sequence opt2 from hemagglutinin__InfluenzaA__AAX76643
augaagaccaucaucgcccucuccuacuuccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91616 - RNA, 1701 nt, Artificial Sequence
  derived and/or modified sequence opt2 from hemagglutinin__InfluenzaA__AAX76653
augaagaccaucaucgcccucuccuacuuccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuucgcccaggccuccggccgcaucaccgucuccaccaagcgcucccagcagaccgucauccccaacaucggcuccggcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91617 - RNA, 1701 nt, Artificial Sequence
  derived and/or modified sequence opt2 from hemagglutinin__InfluenzaA__AAX76663
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91618 - RNA, 1701 nt, Artificial Sequence
  derived and/or modified sequence opt2 from hemagglutinin__InfluenzaA__AAX76673
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91619 - RNA, 1701 nt, Artificial Sequence
  derived and/or modified sequence opt2 from hemagglutinin__InfluenzaA__AAX76683
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91620 - RNA, 1701 nt, Artificial Sequence; identical to SEQ ID NO: 91584
  derived and/or modified sequence opt2 from hemagglutinin__InfluenzaA__AAX76713

SEQ ID NO: 91621 - RNA, 1701 nt, Artificial Sequence
  derived and/or modified sequence opt2 from hemagglutinin__InfluenzaA__AAX76723
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgaggaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91622 - RNA, 1701 nt, Artificial Sequence
  derived and/or modified sequence opt2 from hemagglutinin__InfluenzaA__AAX76733
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccgaccgcaucugcgacuccccccaccagauccucgacggcggcaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaagaacaaguaccccgcccucaacgucgccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuacgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91623 - RNA, 1701 nt, Artificial Sequence
  derived and/or modified sequence opt2 from hemagglutinin__InfluenzaA__AAX76743
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaagaacaaguaccccgcccucaacgucgccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91624 - RNA, 1701 nt, Artificial Sequence
  derived and/or modified sequence opt2 from hemagglutinin__InfluenzaA__AAX76763
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucaucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91625 - RNA, 1701 nt, Artificial Sequence; identical to SEQ ID NO: 91544
  derived and/or modified sequence opt2 from hemagglutinin__InfluenzaA__AAY18086

SEQ ID NO: 91626 - RNA, 1701 nt, Artificial Sequence
  derived and/or modified sequence opt2 from hemagglutinin__InfluenzaA__AAY18096
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91627 - RNA, 1701 nt, Artificial Sequence; identical to SEQ ID NO: 91559
  derived and/or modified sequence opt2 from hemagglutinin__InfluenzaA__AAY18106

SEQ ID NO: 91628 - RNA, 1701 nt, Artificial Sequence; identical to SEQ ID NO: 91559
  derived and/or modified sequence opt2 from hemagglutinin__InfluenzaA__AAY18116

SEQ ID NO: 91629 - RNA, 1701 nt, Artificial Sequence
  derived and/or modified sequence opt2 from hemagglutinin__InfluenzaA__AAY18126
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagggcuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91630 - RNA, 1701 nt, Artificial Sequence
  derived and/or modified sequence opt2 from hemagglutinin__InfluenzaA__AAY18136
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91631 - RNA, 1701 nt, Artificial Sequence; identical to SEQ ID NO: 91584
  derived and/or modified sequence opt2 from hemagglutinin__InfluenzaA__AAY18156

SEQ ID NO: 91632 - RNA, 1701 nt, Artificial Sequence; identical to SEQ ID NO: 91584
  derived and/or modified sequence opt2 from hemagglutinin__InfluenzaA__AAY18176

SEQ ID NO: 91633 - RNA, 1701 nt, Artificial Sequence; identical to SEQ ID NO: 91584
  derived and/or modified sequence opt2 from hemagglutinin__InfluenzaA__AAY18186

SEQ ID NO: 91634 - RNA, 1701 nt, Artificial Sequence; identical to SEQ ID NO: 91585
  derived and/or modified sequence opt2 from hemagglutinin__InfluenzaA__AAY18564

SEQ ID NO: 91635 - RNA, 1701 nt, Artificial Sequence
  derived and/or modified sequence opt2 from hemagglutinin__InfluenzaA__AAY18585
augaagaccaucaucgcccucuccuacauccucugccucgucuucgcccagaagcuccccgagaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91636 - RNA, 1701 nt, Artificial Sequence; identical to SEQ ID NO: 91544
  derived and/or modified sequence opt2 from hemagglutinin__InfluenzaA__AAY18611

SEQ ID NO: 91637 - RNA, 1701 nt, Artificial Sequence; identical to SEQ ID NO: 91585
  derived and/or modified sequence opt2 from hemagglutinin__InfluenzaA__AAY27843

SEQ ID NO: 91638 - RNA, 1701 nt, Artificial Sequence; identical to SEQ ID NO: 91544
  derived and/or modified sequence opt2 from hemagglutinin__InfluenzaA__AAY27853

SEQ ID NO: 91639 - RNA, 1701 nt, Artificial Sequence
  derived and/or modified sequence opt2 from hemagglutinin__InfluenzaA__AAY27863
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugaucuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91640 - RNA, 1701 nt, Artificial Sequence; identical to SEQ ID NO: 91563
  derived and/or modified sequence opt2 from hemagglutinin__InfluenzaA__AAY27959

SEQ ID NO: 91641 - RNA, 1701 nt, Artificial Sequence; identical to SEQ ID NO: 91543
  derived and/or modified sequence opt2 from hemagglutinin__InfluenzaA__AAY27994

SEQ ID NO: 91642 - RNA, 1701 nt, Artificial Sequence; identical to SEQ ID NO: 91543
  derived and/or modified sequence opt2 from hemagglutinin__InfluenzaA__AAY28004

SEQ ID NO: 91643 - RNA, 1701 nt, Artificial Sequence; identical to SEQ ID NO: 91543
  derived and/or modified sequence opt2 from hemagglutinin__InfluenzaA__AAY28265

SEQ ID NO: 91644 - RNA, 1701 nt, Artificial Sequence
  derived and/or modified sequence opt2 from hemagglutinin__InfluenzaA__AAY28275
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91645 - RNA, 1701 nt, Artificial Sequence
  derived and/or modified sequence opt2 from hemagglutinin__InfluenzaA__AAY28285
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacaacgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91646 - RNA, 1701 nt, Artificial Sequence
  derived and/or modified sequence opt2 from hemagglutinin__InfluenzaA__AAY28295
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggcaagaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91647 - RNA, 1701 nt, Artificial Sequence
  derived and/or modified sequence opt2 from hemagglutinin__InfluenzaA__AAY28305
augaaggccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91648 - RNA, 1701 nt, Artificial Sequence
  derived and/or modified sequence opt2 from hemagglutinin__InfluenzaA__AAY28325
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaucgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucgccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91649 - RNA, 1701 nt, Artificial Sequence
  derived and/or modified sequence opt2 from hemagglutinin__InfluenzaA__AAY28335
augaagaccaucaucgcccucuccuacauccucugccucgucuccgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91650 - RNA, 1701 nt, Artificial Sequence; identical to SEQ ID NO: 91544
  derived and/or modified sequence opt2 from hemagglutinin__InfluenzaA__AAY28345

SEQ ID NO: 91651 - RNA, 1701 nt, Artificial Sequence; identical to SEQ ID NO: 91584
  derived and/or modified sequence opt2 from hemagglutinin__InfluenzaA__AAY28355

SEQ ID NO: 91652 - RNA, 1701 nt, Artificial Sequence
  derived and/or modified sequence opt2 from hemagglutinin__InfluenzaA__AAY28363
augaagaccaucaucgcccucuccuacauccucugcauggucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccucccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91653 - RNA, 1701 nt, Artificial Sequence; identical to SEQ ID NO: 91584
  derived and/or modified sequence opt2 from hemagglutinin__InfluenzaA__AAY28375

SEQ ID NO: 91654 - RNA, 1701 nt, Artificial Sequence; identical to SEQ ID NO: 91544
  derived and/or modified sequence opt2 from hemagglutinin__InfluenzaA__AAY28385

SEQ ID NO: 91655 - RNA, 1701 nt, Artificial Sequence
  derived and/or modified sequence opt2 from hemagglutinin__InfluenzaA__AAY28395
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucaaccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91656 - RNA, 1701 nt, Artificial Sequence
  derived and/or modified sequence opt2 from hemagglutinin__InfluenzaA__AAY28405
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaucuccuccaccggccgcaucugcgacaacccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcgucuga

SEQ ID NO: 91657 - RNA, 1701 nt, Artificial Sequence; identical to SEQ ID NO: 91544
  derived and/or modified sequence opt2 from hemagglutinin__InfluenzaA__AAY28486

SEQ ID NO: 91658 - RNA, 1701 nt, Artificial Sequence; identical to SEQ ID NO: 91544
  derived and/or modified sequence opt2 from hemagglutinin__InfluenzaA__AAY28521

SEQ ID NO: 91659 - RNA, 1701 nt, Artificial Sequence; identical to SEQ ID NO: 91543
  derived and/or modified sequence opt2 from hemagglutinin__InfluenzaA__AAY28531

SEQ ID NO: 91660 - RNA, 1701 nt, Artificial Sequence; identical to SEQ ID NO: 91544
  derived and/or modified sequence opt2 from hemagglutinin__InfluenzaA__AAY28541

SEQ ID NO: 91661 - RNA, 1701 nt, Artificial Sequence
  derived and/or modified sequence opt2 from hemagglutinin__InfluenzaA__AAY28551
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91662 - RNA, 1701 nt, Artificial Sequence; identical to SEQ ID NO: 91544
  derived and/or modified sequence opt2 from hemagglutinin__InfluenzaA__AAY28561

SEQ ID NO: 91663 - RNA, 1701 nt, Artificial Sequence; identical to SEQ ID NO: 91559
  derived and/or modified sequence opt2 from hemagglutinin__InfluenzaA__AAY28581

SEQ ID NO: 91664 - RNA, 1701 nt, Artificial Sequence
  derived and/or modified sequence opt2 from hemagglutinin__InfluenzaA__AAY28591
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucgacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91665 - RNA, 1701 nt, Artificial Sequence; identical to SEQ ID NO: 91584
  derived and/or modified sequence opt2 from hemagglutinin__InfluenzaA__AAY28608

SEQ ID NO: 91666 - RNA, 1701 nt, Artificial Sequence
  derived and/or modified sequence opt2 from hemagglutinin__InfluenzaA__AAY28618
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcauguccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91667 - RNA, 1701 nt, Artificial Sequence; identical to SEQ ID NO: 91559
  derived and/or modified sequence opt2 from hemagglutinin__InfluenzaA__AAY28638

SEQ ID NO: 91668 - RNA, 1701 nt, Artificial Sequence
  derived and/or modified sequence opt2 from hemagglutinin__InfluenzaA__AAY28648
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91669 - RNA, 1701 nt, Artificial Sequence
  derived and/or modified sequence opt2 from hemagglutinin__InfluenzaA__AAY44610
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91670 - RNA, 1701 nt, Artificial Sequence
  derived and/or modified sequence opt2 from hemagglutinin__InfluenzaA__AAY44620
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacgagaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91671 - RNA, 1701 nt, Artificial Sequence; identical to SEQ ID NO: 91592
  derived and/or modified sequence opt2 from hemagglutinin__InfluenzaA__AAY44621

SEQ ID NO: 91672 - RNA, 1701 nt, Artificial Sequence; identical to SEQ ID NO: 91559
  derived and/or modified sequence opt2 from hemagglutinin__InfluenzaA__AAY44631

SEQ ID NO: 91673 - RNA, 1701 nt, Artificial Sequence
  derived and/or modified sequence opt2 from hemagglutinin__InfluenzaA__AAY44641
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucggccuccucggcuucaucaugugggccugccagaagggcaacauccgcugcaacaucugcaucuga

SEQ ID NO: 91674 - RNA, 1701 nt, Artificial Sequence
  derived and/or modified sequence opt2 from hemagglutinin__InfluenzaA__AAY44651
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccugggagcgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcucaaggagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91675 - RNA, 1701 nt, Artificial Sequence
  derived and/or modified sequence opt2 from hemagglutinin__InfluenzaA__AAY44755
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcggccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccgucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91676 - RNA, 1701 nt, Artificial Sequence
  derived and/or modified sequence opt2 from hemagglutinin__InfluenzaA__AAY44775
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccaggacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91677 - RNA, 1701 nt, Artificial Sequence; identical to SEQ ID NO: 91584
  derived and/or modified sequence opt2 from hemagglutinin__InfluenzaA__AAY44785

SEQ ID NO: 91678 - RNA, 1701 nt, Artificial Sequence
  derived and/or modified sequence opt2 from hemagglutinin__InfluenzaA__AAY44795
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccacccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91679 - RNA, 1701 nt, Artificial Sequence
  derived and/or modified sequence opt2 from hemagglutinin__InfluenzaA__AAY44796
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91680 - RNA, 1701 nt, Artificial Sequence; identical to SEQ ID NO: 91559
  derived and/or modified sequence opt2 from hemagglutinin__InfluenzaA__AAY44896

SEQ ID NO: 91681 - RNA, 1701 nt, Artificial Sequence
  derived and/or modified sequence opt2 from hemagglutinin__InfluenzaA__AAY44906
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91682 - RNA, 1701 nt, Artificial Sequence
  derived and/or modified sequence opt2 from hemagglutinin__InfluenzaA__AAY46371
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccggcaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91683 - RNA, 1701 nt, Artificial Sequence; identical to SEQ ID NO: 91544
  derived and/or modified sequence opt2 from hemagglutinin__InfluenzaA__AAY46381

SEQ ID NO: 91684 - RNA, 1701 nt, Artificial Sequence
  derived and/or modified sequence opt2 from hemagglutinin__InfluenzaA__AAY46391
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91685 - RNA, 1701 nt, Artificial Sequence
  derived and/or modified sequence opt2 from hemagglutinin__InfluenzaA__AAY46426
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacaagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91686 - RNA, 1701 nt, Artificial Sequence
  derived and/or modified sequence opt2 from hemagglutinin__InfluenzaA__AAY47013
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91687 - RNA, 1701 nt, Artificial Sequence
  derived and/or modified sequence opt2 from hemagglutinin__InfluenzaA__AAY47023
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggaguggggccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcaggcccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91688 - RNA, 1701 nt, Artificial Sequence; identical to SEQ ID NO: 91684
  derived and/or modified sequence opt2 from hemagglutinin__InfluenzaA__AAY47052

SEQ ID NO: 91689 - RNA, 1701 nt, Artificial Sequence
  derived and/or modified sequence opt2 from hemagglutinin__InfluenzaA__AAY47075
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaagaacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91690 - RNA, 1701 nt, Artificial Sequence
  derived and/or modified sequence opt2 from hemagglutinin__InfluenzaA__AAY47085
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacgucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91691 - RNA, 1701 nt, Artificial Sequence
  derived and/or modified sequence opt2 from hemagglutinin__InfluenzaA__AAY58320
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91692 - RNA, 1701 nt, Artificial Sequence
  derived and/or modified sequence opt2 from hemagglutinin__InfluenzaA__AAY59035
augaagaccaucaucgcccucuccuacauccucugccucgucuucgcccagaagcucaccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91693 - RNA, 1701 nt, Artificial Sequence
  derived and/or modified sequence opt2 from hemagglutinin__InfluenzaA__AAY64202
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcgagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagaaccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91694 - RNA, 1701 nt, Artificial Sequence
  derived and/or modified sequence opt2 from hemagglutinin__InfluenzaA__AAY64212
augaagaccaucaucgcccucuccuacauccucugccucgucuucgcccagaagauccccgucaacgacaacuccaccgccacccucugccucggccaccacgccguccccaacggcacccucgucaagaccaucaccaacgagcacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccucaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91695 - RNA, 1701 nt, Artificial Sequence
  derived and/or modified sequence opt2 from hemagglutinin__InfluenzaA__AAY64222
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaucggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccuccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91696 - RNA, 1701 nt, Artificial Sequence
  derived and/or modified sequence opt2 from hemagglutinin__InfluenzaA__AAY64262
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91697 - RNA, 1701 nt, Artificial Sequence
  derived and/or modified sequence opt2 from hemagglutinin__InfluenzaA__AAY64272
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91698 - RNA, 1701 nt, Artificial Sequence
  derived and/or modified sequence opt2 from hemagglutinin__InfluenzaA__AAY64282
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91699 - RNA, 1701 nt, Artificial Sequence
  derived and/or modified sequence opt2 from hemagglutinin__InfluenzaA__AAY64292
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccgacaagaucugcgacuccccccaccagauccucgacggcggcaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaagaacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91700 - RNA, 1701 nt, Artificial Sequence
  derived and/or modified sequence opt2 from hemagglutinin__InfluenzaA__AAY64302
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91701 - RNA, 1701 nt, Artificial Sequence; identical to SEQ ID NO: 91695
  derived and/or modified sequence opt2 from hemagglutinin__InfluenzaA__AAY64312

SEQ ID NO: 91702 - RNA, 1701 nt, Artificial Sequence; identical to SEQ ID NO: 91698
  derived and/or modified sequence opt2 from hemagglutinin__InfluenzaA__AAY64322

SEQ ID NO: 91703 - RNA, 1701 nt, Artificial Sequence
  derived and/or modified sequence opt2 from hemagglutinin__InfluenzaA__AAY64332
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 91704 - RNA, 1701 nt, Artificial Sequence
  derived and/or modified sequence opt2 from hemagglutinin__InfluenzaA__AAY64342
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91705 - RNA, 1701 nt, Artificial Sequence; identical to SEQ ID NO: 91544
  derived and/or modified sequence opt2 from hemagglutinin__InfluenzaA__AAY64352

SEQ ID NO: 91706 - RNA, 1701 nt, Artificial Sequence
  derived and/or modified sequence opt2 from hemagglutinin__InfluenzaA__AAY64362
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91707 - RNA, 1701 nt, Artificial Sequence; identical to SEQ ID NO: 91698
  derived and/or modified sequence opt2 from hemagglutinin__InfluenzaA__AAY64382

SEQ ID NO: 91708 - RNA, 1701 nt, Artificial Sequence
  derived and/or modified sequence opt2 from hemagglutinin__InfluenzaA__AAY64392
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91709 - RNA, 1701 nt, Artificial Sequence; identical to SEQ ID NO: 91700
  derived and/or modified sequence opt2 from hemagglutinin__InfluenzaA__AAY64402

SEQ ID NO: 91710 - RNA, 1701 nt, Artificial Sequence; identical to SEQ ID NO: 91698
  derived and/or modified sequence opt2 from hemagglutinin__InfluenzaA__AAY98037

SEQ ID NO: 91711 - RNA, 1701 nt, Artificial Sequence; identical to SEQ ID NO: 91698
  derived and/or modified sequence opt2 from hemagglutinin__InfluenzaA__AAY98047

SEQ ID NO: 91712 - RNA, 1701 nt, Artificial Sequence; identical to SEQ ID NO: 91559
  derived and/or modified sequence opt2 from hemagglutinin__InfluenzaA__AAY98057

SEQ ID NO: 91713 - RNA, 1701 nt, Artificial Sequence
  derived and/or modified sequence opt2 from hemagglutinin__InfluenzaA__AAY98067
augaagaccaucaucgcccucuccuacauccucugccucgucuucgcccaggagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91714 - RNA, 1701 nt, Artificial Sequence
  derived and/or modified sequence opt2 from hemagglutinin__InfluenzaA__AAY98077
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccgccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91715 - RNA, 1701 nt, Artificial Sequence
  derived and/or modified sequence opt2 from hemagglutinin__InfluenzaA__AAY98087
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91716 - RNA, 1701 nt, Artificial Sequence; identical to SEQ ID NO: 91698
  derived and/or modified sequence opt2 from hemagglutinin__InfluenzaA__AAY98097

SEQ ID NO: 91717 - RNA, 1701 nt, Artificial Sequence; identical to SEQ ID NO: 91698
  derived and/or modified sequence opt2 from hemagglutinin__InfluenzaA__AAY98107

SEQ ID NO: 91718 - RNA, 1701 nt, Artificial Sequence
  derived and/or modified sequence opt2 from hemagglutinin__InfluenzaA__AAY98117
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgcggcuccaacaaguccuucuucucccgccucaacuggcuccaccagcucaaguacaaguaccccgcccucaacgucaccaugcccaacaacgagaaguucgagaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91719 - RNA, 1701 nt, Artificial Sequence; identical to SEQ ID NO: 91698
  derived and/or modified sequence opt2 from hemagglutinin__InfluenzaA__AAY98147

SEQ ID NO: 91720 - RNA, 1701 nt, Artificial Sequence; identical to SEQ ID NO: 91698
  derived and/or modified sequence opt2 from hemagglutinin__InfluenzaA__AAY98157

SEQ ID NO: 91721 - RNA, 1701 nt, Artificial Sequence
  derived and/or modified sequence opt2 from hemagglutinin__InfluenzaA__AAY98167
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccacccagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91722 - RNA, 1701 nt, Artificial Sequence
  derived and/or modified sequence opt2 from hemagglutinin__InfluenzaA__AAY98177
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91723 - RNA, 1701 nt, Artificial Sequence
  derived and/or modified sequence opt2 from hemagglutinin__InfluenzaA__AAY98195
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91724 - RNA, 1701 nt, Artificial Sequence; identical to SEQ ID NO: 91698
  derived and/or modified sequence opt2 from hemagglutinin__InfluenzaA__AAY98207

SEQ ID NO: 91725 - RNA, 1701 nt, Artificial Sequence; identical to SEQ ID NO: 91700
  derived and/or modified sequence opt2 from hemagglutinin__InfluenzaA__AAY98217

SEQ ID NO: 91726 - RNA, 1701 nt, Artificial Sequence; identical to SEQ ID NO: 91698
  derived and/or modified sequence opt2 from hemagglutinin__InfluenzaA__AAY98227

SEQ ID NO: 91727 - RNA, 1701 nt, Artificial Sequence; identical to SEQ ID NO: 91698
  derived and/or modified sequence opt2 from hemagglutinin__InfluenzaA__AAY98237

SEQ ID NO: 91728 - RNA, 1701 nt, Artificial Sequence
  derived and/or modified sequence opt2 from hemagglutinin__InfluenzaA__AAY98247
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91729 - RNA, 1701 nt, Artificial Sequence; identical to SEQ ID NO: 91698
  derived and/or modified sequence opt2 from hemagglutinin__InfluenzaA__AAY98319

SEQ ID NO: 91730 - RNA, 1701 nt, Artificial Sequence
  derived and/or modified sequence opt2 from hemagglutinin__InfluenzaA__AAY98329
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccucggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91731 - RNA, 1701 nt, Artificial Sequence; identical to SEQ ID NO: 91698
  derived and/or modified sequence opt2 from hemagglutinin__InfluenzaA__AAY98339

SEQ ID NO: 91732 - RNA, 1701 nt, Artificial Sequence; identical to SEQ ID NO: 91698
  derived and/or modified sequence opt2 from hemagglutinin__InfluenzaA__AAY98353

SEQ ID NO: 91733 - RNA, 1701 nt, Artificial Sequence
  derived and/or modified sequence opt2 from hemagglutinin__InfluenzaA__AAY98366
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccggcaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91734 - RNA, 1701 nt, Artificial Sequence
  derived and/or modified sequence opt2 from hemagglutinin__InfluenzaA__AAY98376
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91735 - RNA, 1701 nt, Artificial Sequence
  derived and/or modified sequence opt2 from hemagglutinin__InfluenzaA__AAY98386
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcggcaacugcacccucaucgacgcccuccucggcgacccccacugcgacggcuuccagaacaaggagugggaccucuucgucgagcgcuccaaggucuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91736 - RNA, 1701 nt, Artificial Sequence; identical to SEQ ID NO: 91698
  derived and/or modified sequence opt2 from hemagglutinin__InfluenzaA__AAY98396

SEQ ID NO: 91737 - RNA, 1701 nt, Artificial Sequence; identical to SEQ ID NO: 91698
  derived and/or modified sequence opt2 from hemagglutinin__InfluenzaA__AAY98406

SEQ ID NO: 91738 - RNA, 1701 nt, Artificial Sequence
  derived and/or modified sequence opt2 from hemagglutinin__InfluenzaA__AAZ32946
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccgaggccuacuccaacugcuaccccuacgacguccccgacuacgccucccuccgcucccucaucgccuccuccggcacccucgaguucaccaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacaucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91739 - RNA, 1701 nt, Artificial Sequence
  derived and/or modified sequence opt2 from hemagglutinin__InfluenzaA__AAZ32949
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccgaggccuacuccaacugcuaccccuacgacguccccgacuacgccucccuccgcucccucaucgccuccuccggcacccucgaguucaccaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacaucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91740 - RNA, 1701 nt, Artificial Sequence
  derived and/or modified sequence opt2 from hemagglutinin__InfluenzaA__AAZ32950
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccgaggccuacuccaacugcuaccccuacgacguccccgacuacgccucccuccgcucccucaucgccuccuccggcacccucgaguucaccaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacaucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaaggagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91741 - RNA, 1701 nt, Artificial Sequence
  derived and/or modified sequence opt2 from hemagglutinin__InfluenzaA__AAZ32951
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91742 - RNA, 1701 nt, Artificial Sequence
  derived and/or modified sequence opt2 from hemagglutinin__InfluenzaA__AAZ32952
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91743 - RNA, 1701 nt, Artificial Sequence
  derived and/or modified sequence opt2 from hemagglutinin__InfluenzaA__AAZ32953
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91744 - RNA, 1701 nt, Artificial Sequence
  derived and/or modified sequence opt2 from hemagglutinin__InfluenzaA__AAZ38462
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccacuaccccggcaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91745 - RNA, 1701 nt, Artificial Sequence
  derived and/or modified sequence opt2 from hemagglutinin__InfluenzaA__AAZ38473
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucaccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91746 - RNA, 1701 nt, Artificial Sequence; identical to SEQ ID NO: 91698
  derived and/or modified sequence opt2 from hemagglutinin__InfluenzaA__AAZ38484

SEQ ID NO: 91747 - RNA, 1701 nt, Artificial Sequence
  derived and/or modified sequence opt2 from hemagglutinin__InfluenzaA__AAZ38495
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91748 - RNA, 1701 nt, Artificial Sequence
  derived and/or modified sequence opt2 from hemagglutinin__InfluenzaA__AAZ38517
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91749 - RNA, 1701 nt, Artificial Sequence
  derived and/or modified sequence opt2 from hemagglutinin__InfluenzaA__AAZ38539
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacaucuuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91750 - RNA, 1701 nt, Artificial Sequence; identical to SEQ ID NO: 91698
  derived and/or modified sequence opt2 from hemagglutinin__InfluenzaA__AAZ38561

SEQ ID NO: 91751 - RNA, 1701 nt, Artificial Sequence
  derived and/or modified sequence opt2 from hemagglutinin__InfluenzaA__AAZ38583
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 91752 - RNA, 1701 nt, Artificial Sequence
  derived and/or modified sequence opt2 from hemagglutinin__InfluenzaA__AAZ38594
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91753 - RNA, 1701 nt, Artificial Sequence
  derived and/or modified sequence opt2 from hemagglutinin__InfluenzaA__AAZ38605
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccuccaucggcucccgcccccgcauccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91754 - RNA, 1698 nt, Artificial Sequence
  derived and/or modified sequence opt2 from hemagglutinin__InfluenzaA__AAZ38627
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91755 - RNA, 1701 nt, Artificial Sequence
  derived and/or modified sequence opt2 from hemagglutinin__InfluenzaA__AAZ38638
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91756 - RNA, 1701 nt, Artificial Sequence; identical to SEQ ID NO: 91755
  derived and/or modified sequence opt2 from hemagglutinin__InfluenzaA__AAZ38650

SEQ ID NO: 91757 - RNA, 1701 nt, Artificial Sequence
  derived and/or modified sequence opt2 from hemagglutinin__InfluenzaA__AAZ43370
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucaucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaaguccuucuucucccgccucaacuggcucuacgaguccgaguacaaguaccccgcccucaacgucaccaugcccaacaacggcaaguucgacaagcucuacaucuggggcguccaccaccccuccaccgagaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91758 - RNA, 1701 nt, Artificial Sequence; identical to SEQ ID NO: 91630
  derived and/or modified sequence opt2 from hemagglutinin__InfluenzaA__AAZ43394

SEQ ID NO: 91759 - RNA, 1701 nt, Artificial Sequence
  derived and/or modified sequence opt2 from hemagglutinin__InfluenzaA__AAZ43405
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91760 - RNA, 1701 nt, Artificial Sequence; identical to SEQ ID NO: 91559
  derived and/or modified sequence opt2 from hemagglutinin__InfluenzaA__AAZ74352

SEQ ID NO: 91761 - RNA, 1701 nt, Artificial Sequence; identical to SEQ ID NO: 91715
  derived and/or modified sequence opt2 from hemagglutinin__InfluenzaA__AAZ74363

SEQ ID NO: 91762 - RNA, 1698 nt, Artificial Sequence
  derived and/or modified sequence opt2 from hemagglutinin__InfluenzaA__AAZ74374
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacggccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacgucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91763 - RNA, 1701 nt, Artificial Sequence
  derived and/or modified sequence opt2 from hemagglutinin__InfluenzaA__AAZ74397
augaacaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccucugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccggcaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91764 - RNA, 1701 nt, Artificial Sequence
  derived and/or modified sequence opt2 from hemagglutinin__InfluenzaA__AAZ74408
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91765 - RNA, 1701 nt, Artificial Sequence; identical to SEQ ID NO: 91698
  derived and/or modified sequence opt2 from hemagglutinin__InfluenzaA__AAZ74430

SEQ ID NO: 91766 - RNA, 1701 nt, Artificial Sequence; identical to SEQ ID NO: 91755
  derived and/or modified sequence opt2 from hemagglutinin__InfluenzaA__AAZ74441

SEQ ID NO: 91767 - RNA, 1701 nt, Artificial Sequence
  derived and/or modified sequence opt2 from hemagglutinin__InfluenzaA__AAZ74452
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91768 - RNA, 1701 nt, Artificial Sequence
  derived and/or modified sequence opt2 from hemagglutinin__InfluenzaA__AAZ74463
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91769 - RNA, 1701 nt, Artificial Sequence
  derived and/or modified sequence opt2 from hemagglutinin__InfluenzaA__AAZ74474
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagaagcgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91770 - RNA, 1701 nt, Artificial Sequence; identical to SEQ ID NO: 91767
  derived and/or modified sequence opt2 from hemagglutinin__InfluenzaA__AAZ74485

SEQ ID NO: 91771 - RNA, 1701 nt, Artificial Sequence; identical to SEQ ID NO: 91768
  derived and/or modified sequence opt2 from hemagglutinin__InfluenzaA__AAZ74496

SEQ ID NO: 91772 - RNA, 1701 nt, Artificial Sequence; identical to SEQ ID NO: 91767
  derived and/or modified sequence opt2 from hemagglutinin__InfluenzaA__AAZ74507

SEQ ID NO: 91773 - RNA, 1701 nt, Artificial Sequence; identical to SEQ ID NO: 91768
  derived and/or modified sequence opt2 from hemagglutinin__InfluenzaA__AAZ74518

SEQ ID NO: 91774 - RNA, 1701 nt, Artificial Sequence; identical to SEQ ID NO: 91767
  derived and/or modified sequence opt2 from hemagglutinin__InfluenzaA__AAZ74529

SEQ ID NO: 91775 - RNA, 1701 nt, Artificial Sequence
  derived and/or modified sequence opt2 from hemagglutinin__InfluenzaA__AAZ74551
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacacccucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91776 - RNA, 1701 nt, Artificial Sequence; identical to SEQ ID NO: 91698
  derived and/or modified sequence opt2 from hemagglutinin__InfluenzaA__AAZ74562

SEQ ID NO: 91777 - RNA, 1701 nt, Artificial Sequence
  derived and/or modified sequence opt2 from hemagglutinin__InfluenzaA__AAZ74573
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccggcaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91778 - RNA, 1701 nt, Artificial Sequence
  derived and/or modified sequence opt2 from hemagglutinin__InfluenzaA__AAZ74584
augaagaccaucaucgcccucuccuacauccucugccucgucuucgcccagaagcuccccggcaacgacaacuccaccgccacccucugccucggccaccacgccguccccaacggcacccucgucaagaccaucgccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccagaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91779 - RNA, 1701 nt, Artificial Sequence; identical to SEQ ID NO: 91755
  derived and/or modified sequence opt2 from hemagglutinin__InfluenzaA__AAZ74595

SEQ ID NO: 91780 - RNA, 1701 nt, Artificial Sequence
  derived and/or modified sequence opt2 from hemagglutinin__InfluenzaA__AAZ74617
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91781 - RNA, 1701 nt, Artificial Sequence; identical to SEQ ID NO: 91559
  derived and/or modified sequence opt2 from hemagglutinin__InfluenzaA__AAZ79505

SEQ ID NO: 91782 - RNA, 1701 nt, Artificial Sequence
  derived and/or modified sequence opt2 from hemagglutinin__InfluenzaA__AAZ79516
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugccucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91783 - RNA, 1701 nt, Artificial Sequence
  derived and/or modified sequence opt2 from hemagglutinin__InfluenzaA__AAZ79527
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91784 - RNA, 1698 nt, Artificial Sequence
  derived and/or modified sequence opt2 from hemagglutinin__InfluenzaA__AAZ79549
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcaaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91785 - RNA, 1701 nt, Artificial Sequence
  derived and/or modified sequence opt2 from hemagglutinin__InfluenzaA__AAZ79560
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccucaagucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91786 - RNA, 1701 nt, Artificial Sequence
  derived and/or modified sequence opt2 from hemagglutinin__InfluenzaA__AAZ79571
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccgcugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91787 - RNA, 1701 nt, Artificial Sequence
  derived and/or modified sequence opt2 from hemagglutinin__InfluenzaA__AAZ79582
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91788 - RNA, 1698 nt, Artificial Sequence
  derived and/or modified sequence opt2 from hemagglutinin__InfluenzaA__AAZ79604
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaaccgcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91789 - RNA, 1701 nt, Artificial Sequence
  derived and/or modified sequence opt2 from hemagglutinin__InfluenzaA__AAZ79615
augaagaccaucaucgcccucuccuacauccucugccucgucuucgcccagaagauccccggcaacgacaacuccaccgccacccucugcgucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91790 - RNA, 1701 nt, Artificial Sequence
  derived and/or modified sequence opt2 from hemagglutinin__InfluenzaA__AAZ79627
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaaggucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91791 - RNA, 1701 nt, Artificial Sequence; identical to SEQ ID NO: 91768
  derived and/or modified sequence opt2 from hemagglutinin__InfluenzaA__AAZ79941

SEQ ID NO: 91792 - RNA, 1701 nt, Artificial Sequence; identical to SEQ ID NO: 91767
  derived and/or modified sequence opt2 from hemagglutinin__InfluenzaA__AAZ79944

SEQ ID NO: 91793 - RNA, 1701 nt, Artificial Sequence
  derived and/or modified sequence opt2 from hemagglutinin__InfluenzaA__AAZ79963
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccuccaucggcucccgcccccgcauccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91794 - RNA, 1701 nt, Artificial Sequence
  derived and/or modified sequence opt2 from hemagglutinin__InfluenzaA__AAZ79974
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91795 - RNA, 1701 nt, Artificial Sequence; identical to SEQ ID NO: 91767
  derived and/or modified sequence opt2 from hemagglutinin__InfluenzaA__AAZ79996

SEQ ID NO: 91796 - RNA, 1701 nt, Artificial Sequence
  derived and/or modified sequence opt2 from hemagglutinin__InfluenzaA__AAZ80007
augaagaccaucaucgcccucucccacaucuucugccucguccucggccaguaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccgaguccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 91797 - RNA, 1701 nt, Artificial Sequence; identical to SEQ ID NO: 91768
  derived and/or modified sequence opt2 from hemagglutinin__InfluenzaA__AAZ80017

SEQ ID NO: 91798 - RNA, 1701 nt, Artificial Sequence
  derived and/or modified sequence opt2 from hemagglutinin__InfluenzaA__AAZ80030
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91799 - RNA, 1701 nt, Artificial Sequence
  derived and/or modified sequence opt2 from hemagglutinin__InfluenzaA__AAZ83242
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucaaccucuacgcccaggccuccggccgcaucaccgucuccaccaagcgcucccagcagaccgucauccccaacaucggcuaccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91800 - RNA, 1701 nt, Artificial Sequence
  derived and/or modified sequence opt2 from hemagglutinin__InfluenzaA__AAZ83266
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaacgagcucguccaguccuccuccaccggccgcaucugcgacuccccccaccagauccucgacggcgagaacugcacccucaucgacgcccuccucggcgacccccgcugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91801 - RNA, 1701 nt, Artificial Sequence; identical to SEQ ID NO: 91698
  derived and/or modified sequence opt2 from hemagglutinin__InfluenzaA__AAZ83277

SEQ ID NO: 91802 - RNA, 1701 nt, Artificial Sequence; identical to SEQ ID NO: 91584
  derived and/or modified sequence opt2 from hemagglutinin__InfluenzaA__AAZ83288

SEQ ID NO: 91803 - RNA, 1701 nt, Artificial Sequence
  derived and/or modified sequence opt2 from hemagglutinin__InfluenzaA__AAZ83312
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91804 - RNA, 1701 nt, Artificial Sequence
  derived and/or modified sequence opt2 from hemagglutinin__InfluenzaA__AAZ83323
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccaggacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucaucuccaacaucggcucccgccccuggguccgcggcgucuccucccgcaucuccaucuacuggaccaucgucaagcccggcgacauccuccucaucaccuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91805 - RNA, 1701 nt, Artificial Sequence; identical to SEQ ID NO: 91794
  derived and/or modified sequence opt2 from hemagglutinin__InfluenzaA__AAZ83371

SEQ ID NO: 91806 - RNA, 1701 nt, Artificial Sequence; identical to SEQ ID NO: 91767
  derived and/or modified sequence opt2 from hemagglutinin__InfluenzaA__AAZ83688

SEQ ID NO: 91807 - RNA, 1698 nt, Artificial Sequence
  derived and/or modified sequence opt2 from hemagglutinin__InfluenzaA__ABA06510
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucgccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91808 - RNA, 1698 nt, Artificial Sequence
  derived and/or modified sequence opt2 from hemagglutinin__InfluenzaA__ABA08464
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91809 - RNA, 1698 nt, Artificial Sequence; identical to SEQ ID NO: 91808
  derived and/or modified sequence opt2 from hemagglutinin__InfluenzaA__ABA08486

SEQ ID NO: 91810 - RNA, 1698 nt, Artificial Sequence
  derived and/or modified sequence opt2 from hemagglutinin__InfluenzaA__ABA08508
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaagaagaaggagguccucauccucuggggcguccaccacccccccaacaucggcguccagcgcacccucuacuacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91811 - RNA, 1698 nt, Artificial Sequence
  derived and/or modified sequence opt2 from hemagglutinin__InfluenzaA__ABA12707
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91812 - RNA, 1698 nt, Artificial Sequence
  derived and/or modified sequence opt2 from hemagglutinin__InfluenzaA__ABA12715
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucgucuuccucgucucccucggcgccaucuccuucuggaugugcuccaacggcucccuccagugccgcaucugcaucuga

SEQ ID NO: 91813 - RNA, 1698 nt, Artificial Sequence
  derived and/or modified sequence opt2 from hemagglutinin__InfluenzaA__ABA12729
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacaucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuacccccgcuacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91814 - RNA, 1701 nt, Artificial Sequence; identical to SEQ ID NO: 91798
  derived and/or modified sequence opt2 from hemagglutinin__InfluenzaA__ABA12740

SEQ ID NO: 91815 - RNA, 1701 nt, Artificial Sequence; identical to SEQ ID NO: 91767
  derived and/or modified sequence opt2 from hemagglutinin__InfluenzaA__ABA12751

SEQ ID NO: 91816 - RNA, 1701 nt, Artificial Sequence
  derived and/or modified sequence opt2 from hemagglutinin__InfluenzaA__ABA12762
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91817 - RNA, 1701 nt, Artificial Sequence
  derived and/or modified sequence opt2 from hemagglutinin__InfluenzaA__ABA12773
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91818 - RNA, 1701 nt, Artificial Sequence
  derived and/or modified sequence opt2 from hemagglutinin__InfluenzaA__ABA12780
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucgagucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91819 - RNA, 1701 nt, Artificial Sequence
  derived and/or modified sequence opt2 from hemagglutinin__InfluenzaA__ABA16214
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaaguccuucuucucccgccucaacuggcucuacgaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccggcugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaugaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91820 - RNA, 1701 nt, Artificial Sequence; identical to SEQ ID NO: 91768
  derived and/or modified sequence opt2 from hemagglutinin__InfluenzaA__ABA18026

SEQ ID NO: 91821 - RNA, 1698 nt, Artificial Sequence
  derived and/or modified sequence opt2 from hemagglutinin__InfluenzaA__ABA18037
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcucaaggagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91822 - RNA, 1701 nt, Artificial Sequence; identical to SEQ ID NO: 91767
  derived and/or modified sequence opt2 from hemagglutinin__InfluenzaA__ABA18048

SEQ ID NO: 91823 - RNA, 1701 nt, Artificial Sequence
  derived and/or modified sequence opt2 from hemagglutinin__InfluenzaA__ABA18123
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91824 - RNA, 1701 nt, Artificial Sequence; identical to SEQ ID NO: 91767
  derived and/or modified sequence opt2 from hemagglutinin__InfluenzaA__ABA18134

SEQ ID NO: 91825 - RNA, 1698 nt, Artificial Sequence; identical to SEQ ID NO: 91811
  derived and/or modified sequence opt2 from hemagglutinin__InfluenzaA__ABA18145

SEQ ID NO: 91826 - RNA, 1701 nt, Artificial Sequence; identical to SEQ ID NO: 91768
  derived and/or modified sequence opt2 from hemagglutinin__InfluenzaA__ABA18156

SEQ ID NO: 91827 - RNA, 1701 nt, Artificial Sequence
  derived and/or modified sequence opt2 from hemagglutinin__InfluenzaA__ABA26700
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91828 - RNA, 1701 nt, Artificial Sequence
  derived and/or modified sequence opt2 from hemagglutinin__InfluenzaA__ABA26711
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91829 - RNA, 1701 nt, Artificial Sequence
  derived and/or modified sequence opt2 from hemagglutinin__InfluenzaA__ABA26722
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccucccccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91830 - RNA, 1701 nt, Artificial Sequence; identical to SEQ ID NO: 91755
  derived and/or modified sequence opt2 from hemagglutinin__InfluenzaA__ABA26733

SEQ ID NO: 91831 - RNA, 1701 nt, Artificial Sequence; identical to SEQ ID NO: 91755
  derived and/or modified sequence opt2 from hemagglutinin__InfluenzaA__ABA26755

SEQ ID NO: 91832 - RNA, 1701 nt, Artificial Sequence; identical to SEQ ID NO: 91794
  derived and/or modified sequence opt2 from hemagglutinin__InfluenzaA__ABA26766

SEQ ID NO: 91833 - RNA, 1701 nt, Artificial Sequence; identical to SEQ ID NO: 91794
  derived and/or modified sequence opt2 from hemagglutinin__InfluenzaA__ABA26788

SEQ ID NO: 91834 - RNA, 1701 nt, Artificial Sequence; identical to SEQ ID NO: 91794
  derived and/or modified sequence opt2 from hemagglutinin__InfluenzaA__ABA26799

SEQ ID NO: 91835 - RNA, 1698 nt, Artificial Sequence
  derived and/or modified sequence opt2 from hemagglutinin__InfluenzaA__ABA42247
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91836 - RNA, 1698 nt, Artificial Sequence; identical to SEQ ID NO: 91808
  derived and/or modified sequence opt2 from hemagglutinin__InfluenzaA__ABA42258

SEQ ID NO: 91837 - RNA, 1701 nt, Artificial Sequence; identical to SEQ ID NO: 91767
  derived and/or modified sequence opt2 from hemagglutinin__InfluenzaA__ABA42269

SEQ ID NO: 91838 - RNA, 1698 nt, Artificial Sequence
  derived and/or modified sequence opt2 from hemagglutinin__InfluenzaA__ABA42280
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91839 - RNA, 1701 nt, Artificial Sequence
  derived and/or modified sequence opt2 from hemagglutinin__InfluenzaA__ABA42291
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaccgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91840 - RNA, 1701 nt, Artificial Sequence; identical to SEQ ID NO: 91563
  derived and/or modified sequence opt2 from hemagglutinin__InfluenzaA__ABA42302

SEQ ID NO: 91841 - RNA, 1701 nt, Artificial Sequence; identical to SEQ ID NO: 91617
  derived and/or modified sequence opt2 from hemagglutinin__InfluenzaA__ABA42313

SEQ ID NO: 91842 - RNA, 1701 nt, Artificial Sequence; identical to SEQ ID NO: 91563
  derived and/or modified sequence opt2 from hemagglutinin__InfluenzaA__ABA42346

SEQ ID NO: 91843 - RNA, 1701 nt, Artificial Sequence; identical to SEQ ID NO: 91617
  derived and/or modified sequence opt2 from hemagglutinin__InfluenzaA__ABA42357

SEQ ID NO: 91844 - RNA, 1701 nt, Artificial Sequence
  derived and/or modified sequence opt2 from hemagglutinin__InfluenzaA__ABA42379
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuucguccucugcaucguccuccucggcuucaucaugugggccugccagaagggcaacauccgcugcaacaucugcaucuga

SEQ ID NO: 91845 - RNA, 1701 nt, Artificial Sequence; identical to SEQ ID NO: 91592
  derived and/or modified sequence opt2 from hemagglutinin__InfluenzaA__ABA42390

SEQ ID NO: 91846 - RNA, 1701 nt, Artificial Sequence
  derived and/or modified sequence opt2 from hemagglutinin__InfluenzaA__ABA42401
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaguccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91847 - RNA, 1701 nt, Artificial Sequence
  derived and/or modified sequence opt2 from hemagglutinin__InfluenzaA__ABA42412
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccuccggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91848 - RNA, 1701 nt, Artificial Sequence; identical to SEQ ID NO: 91559
  derived and/or modified sequence opt2 from hemagglutinin__InfluenzaA__ABA42443

SEQ ID NO: 91849 - RNA, 1701 nt, Artificial Sequence; identical to SEQ ID NO: 91563
  derived and/or modified sequence opt2 from hemagglutinin__InfluenzaA__ABA42454

SEQ ID NO: 91850 - RNA, 1701 nt, Artificial Sequence
  derived and/or modified sequence opt2 from hemagglutinin__InfluenzaA__ABA42465
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggggccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91851 - RNA, 1701 nt, Artificial Sequence
  derived and/or modified sequence opt2 from hemagglutinin__InfluenzaA__ABA42476
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcaacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91852 - RNA, 1701 nt, Artificial Sequence
  derived and/or modified sequence opt2 from hemagglutinin__InfluenzaA__ABA42498
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91853 - RNA, 1701 nt, Artificial Sequence; identical to SEQ ID NO: 91584
  derived and/or modified sequence opt2 from hemagglutinin__InfluenzaA__ABA42509

SEQ ID NO: 91854 - RNA, 1701 nt, Artificial Sequence
  derived and/or modified sequence opt2 from hemagglutinin__InfluenzaA__ABA42520
augaagaccaucaucgcccucuccuacauccucugccucgucuucgcccagaagcuccccgucaacgacaacuccaccgccacccucugccucggccaccacgccguccccaacggcacccucgucaagaccaucaccaacgacuacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91855 - RNA, 1701 nt, Artificial Sequence
  derived and/or modified sequence opt2 from hemagglutinin__InfluenzaA__ABA42531
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccucuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91856 - RNA, 1701 nt, Artificial Sequence; identical to SEQ ID NO: 91584
  derived and/or modified sequence opt2 from hemagglutinin__InfluenzaA__ABA42542

SEQ ID NO: 91857 - RNA, 1701 nt, Artificial Sequence
  derived and/or modified sequence opt2 from hemagglutinin__InfluenzaA__ABA42553
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgcccacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91858 - RNA, 1701 nt, Artificial Sequence; identical to SEQ ID NO: 91584
  derived and/or modified sequence opt2 from hemagglutinin__InfluenzaA__ABA42564

SEQ ID NO: 91859 - RNA, 1701 nt, Artificial Sequence
  derived and/or modified sequence opt2 from hemagglutinin__InfluenzaA__ABA42928
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucaacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91860 - RNA, 1701 nt, Artificial Sequence; identical to SEQ ID NO: 91584
  derived and/or modified sequence opt2 from hemagglutinin__InfluenzaA__ABA42939

SEQ ID NO: 91861 - RNA, 1701 nt, Artificial Sequence
  derived and/or modified sequence opt2 from hemagglutinin__InfluenzaA__ABA42978
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccauccccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91862 - RNA, 1701 nt, Artificial Sequence; identical to SEQ ID NO: 91755
  derived and/or modified sequence opt2 from hemagglutinin__InfluenzaA__ABA43167

SEQ ID NO: 91863 - RNA, 1701 nt, Artificial Sequence
  derived and/or modified sequence opt2 from hemagglutinin__InfluenzaA__ABA43178
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 91864 - RNA, 1698 nt, Artificial Sequence
  derived and/or modified sequence opt2 from hemagglutinin__InfluenzaA__ABA43189
augaaggccaagcuccucguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91865 - RNA, 1701 nt, Artificial Sequence
  derived and/or modified sequence opt2 from hemagglutinin__InfluenzaA__ABA43200
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucguccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91866 - RNA, 1701 nt, Artificial Sequence
  derived and/or modified sequence opt2 from hemagglutinin__InfluenzaA__ABA43336
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacgucuggggcguccaccaccccaucaccgaccgcgagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91867 - RNA, 1707 nt, Artificial Sequence
  derived and/or modified sequence opt2 from hemagglutinin__InfluenzaA__ABA54915
auggagaaggucguccuccuccucgccaccgccucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcgacuucaacgacuacgaggagcucaagcaccuccucucccgcaucaaccacuucgagaagauccagaucauccccaaguccuccugguccaaccacgaggccuccuccggcgucuccgccgccugccccuaccacggcaagcccuccuucuuccgcaacgucgucuggcucaucaagaagaacuccgccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacaccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacaacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 91868 - RNA, 1698 nt, Artificial Sequence
  derived and/or modified sequence opt2 from hemagglutinin__InfluenzaA__ABA87080
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucaucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaugggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91869 - RNA, 1698 nt, Artificial Sequence; identical to SEQ ID NO: 91808
  derived and/or modified sequence opt2 from hemagglutinin__InfluenzaA__ABA87091

SEQ ID NO: 91870 - RNA, 1698 nt, Artificial Sequence; identical to SEQ ID NO: 91808
  derived and/or modified sequence opt2 from hemagglutinin__InfluenzaA__ABA87231

SEQ ID NO: 91871 - RNA, 1701 nt, Artificial Sequence; identical to SEQ ID NO: 91767
  derived and/or modified sequence opt2 from hemagglutinin__InfluenzaA__ABA87242

SEQ ID NO: 91872 - RNA, 1701 nt, Artificial Sequence; identical to SEQ ID NO: 91768
  derived and/or modified sequence opt2 from hemagglutinin__InfluenzaA__ABA87253

SEQ ID NO: 91873 - RNA, 1698 nt, Artificial Sequence
  derived and/or modified sequence opt2 from hemagglutinin__InfluenzaA__ABB02781
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcgucugcaucuga

SEQ ID NO: 91874 - RNA, 1698 nt, Artificial Sequence; identical to SEQ ID NO: 91813
  derived and/or modified sequence opt2 from hemagglutinin__InfluenzaA__ABB02792

SEQ ID NO: 91875 - RNA, 1698 nt, Artificial Sequence; identical to SEQ ID NO: 91811
  derived and/or modified sequence opt2 from hemagglutinin__InfluenzaA__ABB02803

SEQ ID NO: 91876 - RNA, 1698 nt, Artificial Sequence
  derived and/or modified sequence opt2 from hemagglutinin__InfluenzaA__ABB02814
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91877 - RNA, 1698 nt, Artificial Sequence
  derived and/or modified sequence opt2 from hemagglutinin__InfluenzaA__ABB02825
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91878 - RNA, 1701 nt, Artificial Sequence
  derived and/or modified sequence opt2 from hemagglutinin__InfluenzaA__ABB02836
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcaaccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91879 - RNA, 1701 nt, Artificial Sequence
  derived and/or modified sequence opt2 from hemagglutinin__InfluenzaA__ABB02847
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaucggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91880 - RNA, 1701 nt, Artificial Sequence; identical to SEQ ID NO: 91559
  derived and/or modified sequence opt2 from hemagglutinin__InfluenzaA__ABB02858

SEQ ID NO: 91881 - RNA, 1701 nt, Artificial Sequence
  derived and/or modified sequence opt2 from hemagglutinin__InfluenzaA__ABB02869
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucgucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91882 - RNA, 1701 nt, Artificial Sequence
  derived and/or modified sequence opt2 from hemagglutinin__InfluenzaA__ABB02880
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaaccgcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91883 - RNA, 1701 nt, Artificial Sequence
  derived and/or modified sequence opt2 from hemagglutinin__InfluenzaA__ABB02891
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcgagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91884 - RNA, 1701 nt, Artificial Sequence
  derived and/or modified sequence opt2 from hemagglutinin__InfluenzaA__ABB02902
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91885 - RNA, 1698 nt, Artificial Sequence
  derived and/or modified sequence opt2 from hemagglutinin__InfluenzaA__ABB02913
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccgcccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaaccgcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91886 - RNA, 1698 nt, Artificial Sequence
  derived and/or modified sequence opt2 from hemagglutinin__InfluenzaA__ABB02924
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacgccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91887 - RNA, 1698 nt, Artificial Sequence
  derived and/or modified sequence opt2 from hemagglutinin__InfluenzaA__ABB02936
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91888 - RNA, 1701 nt, Artificial Sequence
  derived and/or modified sequence opt2 from hemagglutinin__InfluenzaA__ABB02947
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccaggacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91889 - RNA, 1701 nt, Artificial Sequence; identical to SEQ ID NO: 91698
  derived and/or modified sequence opt2 from hemagglutinin__InfluenzaA__ABB02958

SEQ ID NO: 91890 - RNA, 1701 nt, Artificial Sequence; identical to SEQ ID NO: 91698
  derived and/or modified sequence opt2 from hemagglutinin__InfluenzaA__ABB02969

SEQ ID NO: 91891 - RNA, 1701 nt, Artificial Sequence
  derived and/or modified sequence opt2 from hemagglutinin__InfluenzaA__ABB02980
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91892 - RNA, 1701 nt, Artificial Sequence
  derived and/or modified sequence opt2 from hemagglutinin__InfluenzaA__ABB02991
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91893 - RNA, 1701 nt, Artificial Sequence
  derived and/or modified sequence opt2 from hemagglutinin__InfluenzaA__ABB03002
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91894 - RNA, 1701 nt, Artificial Sequence
  derived and/or modified sequence opt2 from hemagglutinin__InfluenzaA__ABB03013
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccggcaccgacuccgaccagaccucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91895 - RNA, 1701 nt, Artificial Sequence
  derived and/or modified sequence opt2 from hemagglutinin__InfluenzaA__ABB03024
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggauccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91896 - RNA, 1701 nt, Artificial Sequence
  derived and/or modified sequence opt2 from hemagglutinin__InfluenzaA__ABB03035
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucgccaugcccaacaacgacaaguucgacaagcucuacaucuggggcguccaccaccccggcaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucaccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucguccuccucggcuucaucaugugggccugccagaagggcaacauccgcugcaacaucugcaucuga

SEQ ID NO: 91897 - RNA, 1701 nt, Artificial Sequence
  derived and/or modified sequence opt2 from hemagglutinin__InfluenzaA__ABB03046
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91898 - RNA, 1701 nt, Artificial Sequence
  derived and/or modified sequence opt2 from hemagglutinin__InfluenzaA__ABB03057
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcucggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91899 - RNA, 1701 nt, Artificial Sequence; identical to SEQ ID NO: 91798
  derived and/or modified sequence opt2 from hemagglutinin__InfluenzaA__ABB03068

SEQ ID NO: 91900 - RNA, 1701 nt, Artificial Sequence; identical to SEQ ID NO: 91755
  derived and/or modified sequence opt2 from hemagglutinin__InfluenzaA__ABB03079

SEQ ID NO: 91901 - RNA, 1701 nt, Artificial Sequence; identical to SEQ ID NO: 91755
  derived and/or modified sequence opt2 from hemagglutinin__InfluenzaA__ABB03090

SEQ ID NO: 91902 - RNA, 1698 nt, Artificial Sequence
  derived and/or modified sequence opt2 from hemagglutinin__InfluenzaA__ABB03101
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaagaaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgagaccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91903 - RNA, 1701 nt, Artificial Sequence
  derived and/or modified sequence opt2 from hemagglutinin__InfluenzaA__ABB03112
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacaccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91904 - RNA, 1698 nt, Artificial Sequence
  derived and/or modified sequence opt2 from hemagglutinin__InfluenzaA__ABB03123
augaaggucaagcuccucguccuccucugcaccuucaccgccaccuacgccgacaccaucugcaucggcuaccacgccaacaacuccaccgacaccgucgacaccguccucgagaagaacgucaccgucacccacuucgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91905 - RNA, 1698 nt, Artificial Sequence
  derived and/or modified sequence opt2 from hemagglutinin__InfluenzaA__ABB03134
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccacccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91906 - RNA, 1698 nt, Artificial Sequence; identical to SEQ ID NO: 91811
  derived and/or modified sequence opt2 from hemagglutinin__InfluenzaA__ABB03145

SEQ ID NO: 91907 - RNA, 1701 nt, Artificial Sequence
  derived and/or modified sequence opt2 from hemagglutinin__InfluenzaA__ABB04283
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaaguccuucuucucccgccucaacuggcucuacgaguccgaguccaaguaccccgcccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcccccgccccuggguccgcggccucuccucccgcaucuccaucuacuggaccaucgucaagcccggcgacauccuccucaucaacuccuccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91908 - RNA, 1701 nt, Artificial Sequence
  derived and/or modified sequence opt2 from hemagglutinin__InfluenzaA__ABB04294
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91909 - RNA, 1701 nt, Artificial Sequence
  derived and/or modified sequence opt2 from hemagglutinin__InfluenzaA__ABB04305
augaagaccaucaucgcccucuccuacaucuucugccucgucuucgcccagaagcuccccgagaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguccaaguaccccguccucaacgucaccaugcccaacaacggcaaguucgacaagcucuacaucuggggcguccaccaccccuccaccgacaaggagcagaccaaccucuacguccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91910 - RNA, 1701 nt, Artificial Sequence
  derived and/or modified sequence opt2 from hemagglutinin__InfluenzaA__ABB04316
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucguccuccucggcuucaucaugugggccugccagaagggcaacauccgcugcaacaucugcaucuga

SEQ ID NO: 91911 - RNA, 1701 nt, Artificial Sequence
  derived and/or modified sequence opt2 from hemagglutinin__InfluenzaA__ABB04327
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguacaaguaccccgcccucaacgucaccaugcccaacaacggcaaguucgacaagcucuacaucuggggcguccaccaccccuccaccgagaaggagcagaccaaccucuacguccgcgccuccggccgcgucaccgucuccaccaagcgcucccagcagaccgucauccccaacaucggcuccauccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91912 - RNA, 1701 nt, Artificial Sequence
  derived and/or modified sequence opt2 from hemagglutinin__InfluenzaA__ABB04338
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucguccucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91913 - RNA, 1701 nt, Artificial Sequence
  derived and/or modified sequence opt2 from hemagglutinin__InfluenzaA__ABB04349
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguccaaguaccccguccucaacgucaccaugcccaacaacggcaaguucgacaagcucuacaucuggggcguccaccaccccuccaccgacaaggagcagaccaaccucuacguccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91914 - RNA, 1701 nt, Artificial Sequence
  derived and/or modified sequence opt2 from hemagglutinin__InfluenzaA__ABB04360
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91915 - RNA, 1701 nt, Artificial Sequence
  derived and/or modified sequence opt2 from hemagglutinin__InfluenzaA__ABB04371
augaagaccaucaucgcccucuccuacaucuucuaccucgcccucggccaggaccuccccggcaacgacaacuccaaggccacccucugccucggccaccacgccguccccaacggcacccucgucaagaccaucaccgacgaccagaccgaggucaccaacgccaccgagcucguccaguccuccuccaccggcaagaucugcaacaacccccaccgcauccucgacggcauggacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcaccauggaguucaucaccgagggcuucaccuggaccgaggucacccagaacggcggcuccaacgccugcaagcgcggccccgacuccggcuucuucucccgccucaacuggcucaccaaguccggccgcaccuaccccguccucaacgucaccaugcccaacaacgacaacuucgacaagcucuacaucuggggcguccaccaccccuccaccgaccaggagcagaccaaccucuacguccagaccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 91916 - RNA, 1701 nt, Artificial Sequence
  derived and/or modified sequence opt2 from hemagglutinin__InfluenzaA__ABB04906
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccagaacggcgacuccuacgccugcaagcgcggcuccgucaaguccuucuucucccgccucaacuggcuccacaaguccgaguacaaguaccccgcccucaacgucaccaugcccaacaacgacaaguucgacaagcucuacaucuggggcguccaccaccccuccaccgaccgcgagcagaccucccucuacauccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91917 - RNA, 1701 nt, Artificial Sequence
  derived and/or modified sequence opt2 from hemagglutinin__InfluenzaA__ABB04917
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaucuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91918 - RNA, 1701 nt, Artificial Sequence
  derived and/or modified sequence opt2 from hemagglutinin__InfluenzaA__ABB04928
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaucggcgucacccagaacggcggcuccaacgccugcaagcgcggcaccgacuccggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91919 - RNA, 1701 nt, Artificial Sequence
  derived and/or modified sequence opt2 from hemagglutinin__InfluenzaA__ABB04939
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaucggcaaccucaucgccccccgcggcuacuucaagauccgcaccggcaaguccuccaucaugcgcuccgacgcccccaucggcaucugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccgucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91920 - RNA, 1701 nt, Artificial Sequence
  derived and/or modified sequence opt2 from hemagglutinin__InfluenzaA__ABB04950
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91921 - RNA, 1701 nt, Artificial Sequence
  derived and/or modified sequence opt2 from hemagglutinin__InfluenzaA__ABB04983
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccgaccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 91922 - RNA, 1701 nt, Artificial Sequence; identical to SEQ ID NO: 91684
  derived and/or modified sequence opt2 from hemagglutinin__InfluenzaA__ABB04994

SEQ ID NO: 91923 - RNA, 1701 nt, Artificial Sequence
  derived and/or modified sequence opt2 from hemagglutinin__InfluenzaA__ABB05005
augaagaccaucaucgcccucucccacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccgacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccguccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91924 - RNA, 1701 nt, Artificial Sequence
  derived and/or modified sequence opt2 from hemagglutinin__InfluenzaA__ABB05183
augaagaccaucaucgcccucuccuacauccucugccucgucuucgcccagaagcuccccgucaacgacaacuccaccgccacccucugccucggccaccacgccguccccaacggcacccucgucaagaccaucaccaacgagcacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaaggucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91925 - RNA, 1701 nt, Artificial Sequence
  derived and/or modified sequence opt2 from hemagglutinin__InfluenzaA__ABB05194
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaucaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91926 - RNA, 1701 nt, Artificial Sequence
  derived and/or modified sequence opt2 from hemagglutinin__InfluenzaA__ABB05205
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaacgccuacuccaacugcuaccccuacgacguccccgacuacgccucccuccgcucccucgucgccuccuccggcacccucgaguucaacuccgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacaacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91927 - RNA, 1701 nt, Artificial Sequence; identical to SEQ ID NO: 91584
  derived and/or modified sequence opt2 from hemagglutinin__InfluenzaA__ABB05216

SEQ ID NO: 91928 - RNA, 1701 nt, Artificial Sequence
  derived and/or modified sequence opt2 from hemagglutinin__InfluenzaA__ABB46392
augaagaccaucaucgcccucuccuacaucuucugccucgccuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccaacaccgacaaggagcagaccgaccucuacguccaggccuccggcaaggucaccgucuccaccaagcgcucccagcagaccaucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccagaccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91929 - RNA, 1701 nt, Artificial Sequence
  derived and/or modified sequence opt2 from hemagglutinin__InfluenzaA__ABB46414
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucuucugcgucguccuccucggcuucaucaugugggccugccagaagggcaacauccgcugcaacaucugcaucuga

SEQ ID NO: 91930 - RNA, 1701 nt, Artificial Sequence
  derived and/or modified sequence opt2 from hemagglutinin__InfluenzaA__ABB46425
augaagaccaucaucgcccucuccuacauccucugccucgucuucgcccagaagcuccccggcaacgacaacuccaccgccacccucugccucggccaccacgccguccccaacggcacccucgucaagaccaucaccuccgaccagaucgaggucaccaacgccaccgagcucguccaguccuccuccaccggcaagaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuucgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91931 - RNA, 1701 nt, Artificial Sequence
  derived and/or modified sequence opt2 from hemagglutinin__InfluenzaA__ABB46436
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguacgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91932 - RNA, 1701 nt, Artificial Sequence; identical to SEQ ID NO: 91865
  derived and/or modified sequence opt2 from hemagglutinin__InfluenzaA__ABB46447

SEQ ID NO: 91933 - RNA, 1701 nt, Artificial Sequence
  derived and/or modified sequence opt2 from hemagglutinin__InfluenzaA__ABB46458
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcaaccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucauguggggcugccagaagggcaacauccgcugcaacaucugcaucuga

SEQ ID NO: 91934 - RNA, 1701 nt, Artificial Sequence
  derived and/or modified sequence opt2 from hemagglutinin__InfluenzaA__ABB51961
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuucuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccugcguccgcucccucgucgccuccuccggcacccucgaguucaacaacgaguccuucaacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccacccagcgcugcaagcagcucgucauccccaacaucggcucccgcccccgcguccgcgacgucuccucccgcaucuccaucuacuggaccaucgucaaccccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91935 - RNA, 1698 nt, Artificial Sequence
  derived and/or modified sequence opt2 from hemagglutinin__InfluenzaA__ABB51962
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgccaugucccgcggcuucggcuccggcaucuccaccuccaacgcccccaugggcgagugcgacgccaaguuccagaccccccagggcggcaucaacaucucccuccccuuccagaacguccaccccgucaccaucggcgagugccccaacuacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuccgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91936 - RNA, 1701 nt, Artificial Sequence
  derived and/or modified sequence opt2 from hemagglutinin__InfluenzaA__ABB51963
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgccacauccccucccgcaucuccaucuacuggaccaucgucaaccccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagaaccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacgagaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaaggucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91937 - RNA, 1701 nt, Artificial Sequence; identical to SEQ ID NO: 91794
  derived and/or modified sequence opt2 from Hemagglutinin__InfluenzaA__ABB51964

SEQ ID NO: 91938 - RNA, 1698 nt, Artificial Sequence
  derived and/or modified sequence opt2 from hemagglutinin__InfluenzaA__ABB53603
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaagaagaaggagguccucauccucuggggcguccaccacccccccaacaucggcaaccagcgcacccucuacuacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91939 - RNA, 1701 nt, Artificial Sequence; identical to SEQ ID NO: 91767
  derived and/or modified sequence opt2 from hemagglutinin__InfluenzaA__ABB53614

SEQ ID NO: 91940 - RNA, 1701 nt, Artificial Sequence; identical to SEQ ID NO: 91767
  derived and/or modified sequence opt2 from hemagglutinin__InfluenzaA__ABB53625

SEQ ID NO: 91941 - RNA, 1701 nt, Artificial Sequence; identical to SEQ ID NO: 91794
  derived and/or modified sequence opt2 from hemagglutinin__InfluenzaA__ABB53652

SEQ ID NO: 91942 - RNA, 1701 nt, Artificial Sequence
  derived and/or modified sequence opt2 from hemagglutinin__InfluenzaA__ABB53663
augaagaccaucuucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaacuucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91943 - RNA, 1701 nt, Artificial Sequence; identical to SEQ ID NO: 91767
  derived and/or modified sequence opt2 from hemagglutinin__InfluenzaA__ABB53685

SEQ ID NO: 91944 - RNA, 1701 nt, Artificial Sequence
  derived and/or modified sequence opt2 from hemagglutinin__InfluenzaA__ABB53696
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacgucugcaucuga

SEQ ID NO: 91945 - RNA, 1698 nt, Artificial Sequence; identical to SEQ ID NO: 91808
  derived and/or modified sequence opt2 from hemagglutinin__InfluenzaA__ABB53707

SEQ ID NO: 91946 - RNA, 1701 nt, Artificial Sequence; identical to SEQ ID NO: 91755
  derived and/or modified sequence opt2 from hemagglutinin__InfluenzaA__ABB53718

SEQ ID NO: 91947 - RNA, 1698 nt, Artificial Sequence
  derived and/or modified sequence opt2 from hemagglutinin__InfluenzaA__ABB53740
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaugggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgagaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91948 - RNA, 1701 nt, Artificial Sequence
  derived and/or modified sequence opt2 from hemagglutinin__InfluenzaA__ABB53751
augaagaccaucaucgcccucuccuacaucuccugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgacaacuccuucuucucccgccucaacuggcucuacaaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccuccggcaucuccaucuacuggaccaucgucaagcccggcgacauccuccucaucaacuccaacggcaaccucaucgccccccgcggcuacuucaagauccgcaccggcaaguccuccauccuccgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91949 - RNA, 1701 nt, Artificial Sequence
  derived and/or modified sequence opt2 from hemagglutinin__InfluenzaA__ABB60007
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccgaccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91950 - RNA, 1701 nt, Artificial Sequence
  derived and/or modified sequence opt2 from hemagglutinin__InfluenzaA__ABB77853
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccgacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91951 - RNA, 1701 nt, Artificial Sequence
  derived and/or modified sequence opt2 from hemagglutinin__InfluenzaA__ABB79731
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91952 - RNA, 1701 nt, Artificial Sequence
  derived and/or modified sequence opt2 from hemagglutinin__InfluenzaA__ABB79788
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccaucaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91953 - RNA, 1701 nt, Artificial Sequence
  derived and/or modified sequence opt2 from hemagglutinin__InfluenzaA__ABB79799
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91954 - RNA, 1701 nt, Artificial Sequence
  derived and/or modified sequence opt2 from hemagglutinin__InfluenzaA__ABB79810
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgccucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugccgccgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccaguccucccgcaucuccaucuacuggaccaucgucaagcccggcgacauccuccucaucgacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagcacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91955 - RNA, 1701 nt, Artificial Sequence
  derived and/or modified sequence opt2 from hemagglutinin__InfluenzaA__ABB79957
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgccucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugccgccgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccaguccucccgcaucggcaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagcacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91956 - RNA, 1701 nt, Artificial Sequence
  derived and/or modified sequence opt2 from hemagglutinin__InfluenzaA__ABB79968
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgccucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugccgccgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagcacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91957 - RNA, 1698 nt, Artificial Sequence
  derived and/or modified sequence opt2 from hemagglutinin__InfluenzaA__ABB79979
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuaccacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91958 - RNA, 1698 nt, Artificial Sequence
  derived and/or modified sequence opt2 from hemagglutinin__InfluenzaA__ABB79990
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91959 - RNA, 1701 nt, Artificial Sequence
  derived and/or modified sequence opt2 from hemagglutinin__InfluenzaA__ABB80001
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 91960 - RNA, 1701 nt, Artificial Sequence; identical to SEQ ID NO: 91755
  derived and/or modified sequence opt2 from hemagglutinin__InfluenzaA__ABB80012

SEQ ID NO: 91961 - RNA, 1701 nt, Artificial Sequence
  derived and/or modified sequence opt2 from hemagglutinin__InfluenzaA__ABB80023
augaagaccaucaucgcccucuccuacaucuucuaccucgcccucggccaggaccuccccggcaacgacaacuccaaggccacccucugccucggccaccacgccguccccaacggcacccucgucaagaccaucaccaacgaccagaccgaggucaccaacgccaccgagcucguccaguccuccuccaccggcaagaucugcaacaacccccaccgcauccucgacggcauggacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccgaggucacccagaacggcggcuccaacgccugcaagcgcggccccgacuccggcuucuucucccgccucaacuggcucaccaaguccggccgcaccuaccccguccucaacgucaccaugcccaacaacgacaacuucgacaagcucuacaucuggggcguccaccaccccuccaccgaccaggagcagaccaaccucuacguccagaccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcaggacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 91962 - RNA, 1701 nt, Artificial Sequence
  derived and/or modified sequence opt2 from hemagglutinin__InfluenzaA__ABB80034
augaagaccaucaucgcccucuccuacaucuucugccucguccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggccucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgccaccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 91963 - RNA, 1698 nt, Artificial Sequence; identical to SEQ ID NO: 91876
  derived and/or modified sequence opt2 from hemagglutinin__InfluenzaA__ABB80045

SEQ ID NO: 91964 - RNA, 1701 nt, Artificial Sequence
  derived and/or modified sequence opt2 from hemagglutinin__InfluenzaA__ABB80081
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91965 - RNA, 1701 nt, Artificial Sequence
  derived and/or modified sequence opt2 from hemagglutinin__InfluenzaA__ABB80092
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggacccucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91966 - RNA, 1701 nt, Artificial Sequence; identical to SEQ ID NO: 91767
  derived and/or modified sequence opt2 from hemagglutinin__InfluenzaA__ABB80137

SEQ ID NO: 91967 - RNA, 1701 nt, Artificial Sequence; identical to SEQ ID NO: 91964
  derived and/or modified sequence opt2 from hemagglutinin__InfluenzaA__ABB80159

SEQ ID NO: 91968 - RNA, 1701 nt, Artificial Sequence; identical to SEQ ID NO: 91535
  derived and/or modified sequence opt2 from hemagglutinin__InfluenzaA__ABB80185

SEQ ID NO: 91969 - RNA, 1701 nt, Artificial Sequence
  derived and/or modified sequence opt2 from hemagglutinin__InfluenzaA__ABB80207
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 91970 - RNA, 1701 nt, Artificial Sequence
  derived and/or modified sequence opt2 from hemagglutinin__InfluenzaA__ABB80229
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 91971 - RNA, 1701 nt, Artificial Sequence; identical to SEQ ID NO: 91964
  derived and/or modified sequence opt2 from hemagglutinin__InfluenzaA__ABB80240

SEQ ID NO: 91972 - RNA, 1701 nt, Artificial Sequence
  derived and/or modified sequence opt2 from hemagglutinin__InfluenzaA__ABB80251
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggccucaucaugugggccugccagaagggcaacauccgcugcaacaucugcaucuga

SEQ ID NO: 91973 - RNA, 1701 nt, Artificial Sequence
  derived and/or modified sequence opt2 from hemagglutinin__InfluenzaA__ABB80492
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 91974 - RNA, 1701 nt, Artificial Sequence
  derived and/or modified sequence opt2 from hemagglutinin__InfluenzaA__ABB80503
augaagaccaucaucgcccucuccuacaucuccugccucgucuucgcccagaagcuccccggcaacgacaacaacaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcuccgcuccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91975 - RNA, 1701 nt, Artificial Sequence; identical to SEQ ID NO: 91964
  derived and/or modified sequence opt2 from hemagglutinin__InfluenzaA__ABB80514

SEQ ID NO: 91976 - RNA, 1701 nt, Artificial Sequence
  derived and/or modified sequence opt2 from hemagglutinin__InfluenzaA__ABB80529
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgacaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91977 - RNA, 1701 nt, Artificial Sequence
  derived and/or modified sequence opt2 from hemagglutinin__InfluenzaA__ABB80641
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacgucuccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91978 - RNA, 1701 nt, Artificial Sequence
  derived and/or modified sequence opt2 from hemagglutinin__InfluenzaA__ABB80661
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccaggccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91979 - RNA, 1701 nt, Artificial Sequence
  derived and/or modified sequence opt2 from hemagglutinin__InfluenzaA__ABB80672
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagggcuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91980 - RNA, 1701 nt, Artificial Sequence
  derived and/or modified sequence opt2 from hemagglutinin__InfluenzaA__ABB80682
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcuccucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91981 - RNA, 1701 nt, Artificial Sequence
  derived and/or modified sequence opt2 from hemagglutinin__InfluenzaA__ABB80693
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaugugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91982 - RNA, 1701 nt, Artificial Sequence
  derived and/or modified sequence opt2 from hemagglutinin__InfluenzaA__ABB80704
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91983 - RNA, 1701 nt, Artificial Sequence; identical to SEQ ID NO: 91964
  derived and/or modified sequence opt2 from hemagglutinin__InfluenzaA__ABB80715

SEQ ID NO: 91984 - RNA, 1701 nt, Artificial Sequence
  derived and/or modified sequence opt2 from hemagglutinin__InfluenzaA__ABB80724
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccaggccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 91985 - RNA, 1701 nt, Artificial Sequence; identical to SEQ ID NO: 91970
  derived and/or modified sequence opt2 from hemagglutinin__InfluenzaA__ABB80737

SEQ ID NO: 91986 - RNA, 1701 nt, Artificial Sequence
  derived and/or modified sequence opt2 from hemagglutinin__InfluenzaA__ABB80748
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccacccagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgaggaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91987 - RNA, 1701 nt, Artificial Sequence
  derived and/or modified sequence opt2 from hemagglutinin__InfluenzaA__ABB82183
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgccuccaucggccgcugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 91988 - RNA, 1698 nt, Artificial Sequence; identical to SEQ ID NO: 91808
  derived and/or modified sequence opt2 from hemagglutinin__InfluenzaA__ABB82194

SEQ ID NO: 91989 - RNA, 1698 nt, Artificial Sequence
  derived and/or modified sequence opt2 from hemagglutinin__InfluenzaA__ABB82205
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacuccaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91990 - RNA, 1698 nt, Artificial Sequence
  derived and/or modified sequence opt2 from hemagglutinin__InfluenzaA__ABB82216
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccuccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91991 - RNA, 1701 nt, Artificial Sequence
  derived and/or modified sequence opt2 from hemagglutinin__InfluenzaA__ABB82227
augaagaccaucaucgcccucuccuacaucuucugccucacccucggccaggaccuccccggcaacgacaacuccaaggccacccucugccucggccaccacgccguccccaacggcacccucgucaagaccaucaccgacgaccagaccgaggucaccaacgccaccgagcucguccaguccuccuccaccggcaagaucugcaacaacccccaccgcauccucgacggcauggacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgccgccuccuccggcacccucgaguucaucaccgagggcuucaccuggaccggcgucacccagaacggcggcuccaacgccugcaagcgcggccccggcuccggcuucuucucccgccucaacuggcucaccaaguccggcaacaccuaccccguccucaacgucaccaugcccaacaacgacaacuucgacaagcucuacaucuggggcguccaccaccccuccaccgaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacaucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgccauggagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 91992 - RNA, 1698 nt, Artificial Sequence
  derived and/or modified sequence opt2 from hemagglutinin__InfluenzaA__ABB83026
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91993 - RNA, 1698 nt, Artificial Sequence
  derived and/or modified sequence opt2 from hemagglutinin__InfluenzaA__ABB83127
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91994 - RNA, 1698 nt, Artificial Sequence
  derived and/or modified sequence opt2 from hemagglutinin__InfluenzaA__ABB83138
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccaucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 91995 - RNA, 1701 nt, Artificial Sequence
  derived and/or modified sequence opt2 from hemagglutinin__InfluenzaA__ABB86877
augaaggccauccuccucauccuccucuacaccuucaccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaaccucggcggcaucgccccccucuaccucggcaacugcaacaucgccggcuggcuccucggcaaccccgagugcgagcuccucuucaccgucuccuccugguccuacaucgucgagaccuccaacuccgacaacggcaccugcuaccccggcgacuucaucaacuacgaggagcuccgcgagcagcucuccuccauguccuccuacgagcgcuucgagaucuuccccaaggaguccuccuggcccaaccacgagaccaaccgcggcgucaccgccgccugccccuacgccggcgccaacuccuucuaccgcaaccucaucuggcucgucaagaagggcaacuccuaccccaagaucaacaaguccuacgucaacaacaaggagaaggagguccucguccucuggggcauccaccacccccccaccuccgccgaccagcagucccucuaccagaacgccgacgccuacgucuccgucgaguccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaaccgcggcuccggcuccggcaucaucaucuccgacacccccguccacgacugcaacaccaccugccagacccccaagggcgccaucaacaccucccuccccuuccagaacguccaccccgucaccaucggcgagugccccaaguacgucaaguccaccaagcuccgcauggccaccggccuccgcaacauccccuccauccagucccgcggccucuucgaggccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccguccgcaacggcaccuacgacuaccucaaguacuccgaggaguccaagcucaaccgcgagaagaucgagggcgucaagcucgacuccgcccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 91996 - RNA, 1701 nt, Artificial Sequence
  derived and/or modified sequence opt2 from hemagglutinin__InfluenzaA__ABB86887
augaaggccauccuccucauccuccucuacaccuucaccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaaccucggcggcaucgccccccucuaccucggcaacugcaacaucgccggcuggcuccucggcaaccccgagugcgagcuccucuucaccgucuccuccugguccuacaucgucgagaccuccaacuccgacaacggcaccugcuaccccggcgacuucaucaacuacgaggagcuccgcgagcagcucuccuccauguccuccuacgagcgcuucgagaucuuccccaaggaguccuccuggcccaaccacgagaccaaccgcggcgucaccgccgccugccccuacgccggcgccaacuccuucuaccgcaaccucaucuggcucgucaagaagggcaacuccuaccccaagaucaacaaguccuacgucaacaacaaggagaaggagguccucguccucuggggcauccaccacccccccaccuccgccgaccagcagucccucuaccagaacgccgacgccuacgucuccgucgaguccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccguccgcaacggcaccuacgacuaccucaaguacuccgaggaguccaagcucaaccgcgagaagaucgagggcgucaagcucgacuccgcccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 91997 - RNA, 1698 nt, Artificial Sequence
  derived and/or modified sequence opt2 from hemagglutinin__InfluenzaA__ABB86899
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggccacuucgccgacuacgaggagcuccgcgagcagcucuccuccgucuccuccuucgagcgcuucgagaucuuccccaaggaguccuccuggcccaaccacaccaucaccggcgucuccgccuccugcucccacaacggcaagcgcuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucauccuccucgucucccucggcgccaucuccuucuggaugugcuccaacggcucccuccagugccgcaucugcaucuga

SEQ ID NO: 91998 - RNA, 1701 nt, Artificial Sequence
  derived and/or modified sequence opt2 from hemagglutinin__InfluenzaA__ABB86907
augaaggccauccuccucguccuccucuacaccuucaccuccaccaacgccgacacccucugcaucggcuaccacgccaacaacuccaccgacaccgucgacaccguccucgagaagaacgucaccgucacccacuccgucaaccuccucgaggacaagcacaacggcaagcucugccgccucggcggcaucgccccccuccaccucggcaagugcaacaucgccggcuggcuccucggcaaccccgagugcgaccuccuccucaccgucuccuccugguccuacaucgucgagaccuccaacuccuacaacggcaccugcuaccccggcgacuucaccaacuacgaggagcuccgcgagcagcucuccuccgucuccuccuucgagcgcuucgagaucuuccccaaggccuccuccuggcccaaccacgagaccaaccgcggcgucaccgccgccugcccccacgccggcaccaacuccuucuaccgcaaccucaucuggcucgucaagaagggcaacaccuaccccaagcucuccaaguccuacgucaacaacaagggcaaggagguccucguccucuggggcauccaccaccccuccaccuccaccgaccagcagucccucuaccagaacgccgacaccuacgucuucgucggcaccuccaaguacaacaagaaguucaagcccgagaucgccguccgccccaaggucaaggaccaggccggccgcaugaacuacuacuggacccucgucgagcccggcgacaccaucaccuucgaggccaccggcaaccucgucgucccccgcuacgccuucgccaugaaccgcggccacggcuccggcaucaucaucuccgacacccccguccacgacugcaacaccaccugccagacccccaagggcgccaucaacaccucccuccccuuccagaacguccaccccgucaccaucggcaagugccccaaguacgucaaguccacccgccuccgcauggccaccggccuccgcaacauccccuccauccagucccgcggccucuucggcgccaucgccggcuucaucgagggcggcuggaccggcaugaucgacggcugguacggcuaccaccaccagaacggccagggcuccggcuacgccgccgaccagaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgccgccagcucaagaacaacgccaaggagaucggcaacggcugcuucgaguucuaccacaacugcgacgacgccugcauggaguccgucaagaacggcaccuacgacuaccccaaguacuccgaggagucccgccucaaccgcgaggagaucaacggcaucaagcucgacuccacccgcaucuaccagauccucgccaucuacuccaccgucgccuccuccuccguccuccucgucucccucggcgccaucuccuucuggaugugcuccaacggcucccuccagugccgcaucugcaucuga

SEQ ID NO: 91999 - RNA, 1698 nt, Artificial Sequence
  derived and/or modified sequence opt2 from hemagglutinin__InfluenzaA__ABB86917
augaaggucaagcuccucauccuccucugcaccuucaccgccaccuacgccgaccccaucugcaucggcuaccacgccaacaacuccaccgacaccgucgacaccguccucgagaagaacgucgccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92000 - RNA, 1698 nt, Artificial Sequence
  derived and/or modified sequence opt2 from hemagglutinin__InfluenzaA__ABB86929
augaaggucaagcuccucauccuccucuacaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggccacuucgccgacuacgaggagcuccgcgagcagcucuccuccgucuccuccuucgagcgcuucgagaucuuccccaaggaguccuccuggcccaaccacaccaucaccggcgucuccgccuccugcucccacaacggcaagcgcuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucauccuccucgucucccucggcgccaucuccuucuggaugugcuccaacggcucccuccagugccgcaucugcaucuga

SEQ ID NO: 92001 - RNA, 1701 nt, Artificial Sequence
  derived and/or modified sequence opt2 from hemagglutinin__InfluenzaA__ABB86937
augaaggccauccuccucguccuccucuacaccuucaccuccaccaacgccgacacccucugcaucggcuaccacgccaacaacuccaccgacaccgucgacaccguccucgagaagaacgucaccgucacccacuccgucaaccuccucgaggacaagcacaacggccgccucugcaagcucggcggcaucgccccccuccaccucggcaagugcaacaucgccggcuggcuccucggcaaccccgagugcgagcuccucuucaccgucuccuccugguccuacaucgucgagaccuccaacuccuacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugcccccacgccggcaccaacuccuucuaccgcaaccucaucuggcucgucaagaagggcaacaccuaccccaagaucuccaaguccuacgucaacaacaagggcaaggagguccucguccucuggggcauccaccaccccuccaccuccaacgaccagcagucccucuaccagaacgccgacaccuacgucuucgucggccccuccaaguacaacaagaaguucaagcccgagaucgccacccgccccaagguccgcgaccaggccggccgcaugaacuacuacuggacccucgucgagcccggcgacaccaucaccuucgaggccaccggcaaccucgucgucccccgcuacgccuucgccaugaaccgcggcuccgaguccggcaucaucaucuccgacacccccguccacgacugcaacaccaccugccagacccccaagggcgccaucaacaccucccuccccuuccagaacguccaccccgucaccaucggcgagugccccaaguacgucaaguccacccgccuccgcauggccaccggccuccgcaacauccccuccauccagucccgcggccucuucggcgccaucgccggcuucaucgaggagggcuggaccggcaugaucgacggcugguacggcuaccaccaccagaacggccagggcuccggcuacgccgccgaccagaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgccgccagcucaagaacaacgccaaggagaucggcaacggcugcuucgaguucuaccacaagugcgacgacgccugcauggaguccgucaagaacggcaccuacgacuaccccaaguacuccgaggagucccgccucaaccgcgaggagaucaacggcaucaagcucgacuccacccgcaucuaccagauccucgccaucuacuccaccgucgccuccuccuccguccuccucgucucccucggcgccaucuccuucuggaugugcuccaacggcucccuccagugccgcaucugcaucuga

SEQ ID NO: 92002 - RNA, 1701 nt, Artificial Sequence
  derived and/or modified sequence opt2 from hemagglutinin__InfluenzaA__ABB86946
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcaucgccccccuccaccucggcaagugcaacaucgccggcuggcuccucggcaaccccgagugcgagucccucuccaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcaccaccgccgccugccccuacgccggcgccaacuccuucuaccgcaaccucaucuggcucgucaagaagggcaacuccuaccccaagcucaacaaguccuacgucaacaacaagggcaaggagguccucguccucuggggcauccaccaccccuccaccuccaacgagcagcagucccucuaccagaacgccgacaccuacgucuucgucggcuccuccaaguacaacaagaaguucaagcccgagaucgccacccgccccaagguccgcgaccaggccggccgcaugaacuacuacuggacccucaucgagcccggcgacaccaucaccuucgaggccaccggcaaccucgucgucccccgcuacgccuucgccaugaaccgcggcuccggcuccggcaucaucaucuccgacacccccguccacgacugcaacaccaccugccagacccccaagggcgccaucaacaccucccuccccuuccagaacguccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcucaagaacaacgccaaggagaucggcaacggcugcuucgaguucuaccacaagugcgacgacgccugcauggaguccgucaagaacggcaccuacgacuaccccaaguacuccgaggagucccgccucaaccgcgaggagaucgacggcaucaagcucgacuccacccgcaucuaccagauccucgccaucuacuccaccgucgccuccuccuccguccuccucgucucccucggcgccaucuccuucuggaugugcuccaacggcucccuccagugccgcaucugcaucuga

SEQ ID NO: 92003 - RNA, 1701 nt, Artificial Sequence
  derived and/or modified sequence opt2 from hemagglutinin__InfluenzaA__ABB96319
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucuucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcccccgccccuggguccgcggccucuccucccgcaucuccaucuacuggaccaucgucaagcccggcgacguccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92004 - RNA, 1701 nt, Artificial Sequence
  derived and/or modified sequence opt2 from hemagglutinin__InfluenzaA__ABB96330
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucuucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacguccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgaccgccccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92005 - RNA, 1701 nt, Artificial Sequence
  derived and/or modified sequence opt2 from hemagglutinin__InfluenzaA__ABB96341
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucuucaacgagggcuucaacuggaccggcgucacccagaacggcggcuccuacgccugcaagaagggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacguccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92006 - RNA, 1701 nt, Artificial Sequence
  derived and/or modified sequence opt2 from hemagglutinin__InfluenzaA__ABB96395
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucauggacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagcgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92007 - RNA, 1698 nt, Artificial Sequence
  derived and/or modified sequence opt2 from hemagglutinin__InfluenzaA__ABB96487
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaagaaguccuccuggcccaaccacaccgucaccggcgucuccgccuccugcucccacgacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92008 - RNA, 1701 nt, Artificial Sequence
  derived and/or modified sequence opt2 from hemagglutinin__InfluenzaA__ABB96520
augaagaccaucaucgcccucuccuacaucuucugccucgcccucggccaggaccuccccggcaacggcaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaagacccucaagcucgccaccggcaugcgcaacauccccgagaagaagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 92009 - RNA, 1701 nt, Artificial Sequence
  derived and/or modified sequence opt2 from hemagglutinin__InfluenzaA__ABB96531
augaagaccaucaucgcccucuccuacauccucugccucgucuccgcccagaagauccccggcaacgacuccuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92010 - RNA, 1701 nt, Artificial Sequence
  derived and/or modified sequence opt2 from hemagglutinin__InfluenzaA__ABC02234
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagaucucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccucuucugcgucguccuccucggcuucaucaugugggccugccagaagggcaacauccgcugcaacaucugcaucuga

SEQ ID NO: 92011 - RNA, 1701 nt, Artificial Sequence
  derived and/or modified sequence opt2 from hemagglutinin__InfluenzaA__ABC02255
augaagaccaucaucgcccucuccuacaucuucugccucguccucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggccacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92012 - RNA, 1701 nt, Artificial Sequence
  derived and/or modified sequence opt2 from hemagglutinin__InfluenzaA__ABC02266
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcucccgcgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92013 - RNA, 1701 nt, Artificial Sequence
  derived and/or modified sequence opt2 from hemagglutinin__InfluenzaA__ABC02288
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggccacaaggacuggauccucuggaucuccuucgccaucuccugcuuccuccucugcgucguccuccucggcuucaucaugugggccugccagaagggcaacauccgcugcaacaucugcaucuga

SEQ ID NO: 92014 - RNA, 1701 nt, Artificial Sequence; identical to SEQ ID NO: 91982
  derived and/or modified sequence opt2 from hemagglutinin__InfluenzaA__ABC02299

SEQ ID NO: 92015 - RNA, 1701 nt, Artificial Sequence; identical to SEQ ID NO: 92006
  derived and/or modified sequence opt2 from hemagglutinin__InfluenzaA__ABC02310

SEQ ID NO: 92016 - RNA, 1701 nt, Artificial Sequence; identical to SEQ ID NO: 92011
  derived and/or modified sequence opt2 from hemagglutinin__InfluenzaA__ABC02321

SEQ ID NO: 92017 - RNA, 1701 nt, Artificial Sequence; identical to SEQ ID NO: 91817
  derived and/or modified sequence opt2 from hemagglutinin__InfluenzaA__ABC02332

SEQ ID NO: 92018 - RNA, 1701 nt, Artificial Sequence
  derived and/or modified sequence opt2 from hemagglutinin__InfluenzaA__ABC39805
augaagaccaucaucgcccucuccuacauccucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccgccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccaggacuacgccucccuccgcucccucgucgccuccuccggcacccucgaguucaucaacgagggcuucaacuggaccggcgucacccaguccggcggcuccuacgccugcaagcgcggcuccggcaacuccuucuucucccgccucaacuggcucuacaaguccgaguccaaguaccccgcccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccuccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92019 - RNA, 1698 nt, Artificial Sequence
  derived and/or modified sequence opt2 from hemagglutinin__InfluenzaA__ABC40522
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92020 - RNA, 1698 nt, Artificial Sequence; identical to SEQ ID NO: 91808
  derived and/or modified sequence opt2 from hemagglutinin__InfluenzaA__ABC40533

SEQ ID NO: 92021 - RNA, 1701 nt, Artificial Sequence
  derived and/or modified sequence opt2 from hemagglutinin__InfluenzaA__ABC40555
augaagaccaucaucgcccucuccuacaucuucugccucgucuucgcccagaaccucccccgcaacgacaaguccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92022 - RNA, 1701 nt, Artificial Sequence
  derived and/or modified sequence opt2 from hemagglutinin__InfluenzaA__ABC40608
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccacccgccgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccaguccgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92023 - RNA, 1701 nt, Artificial Sequence
  derived and/or modified sequence opt2 from hemagglutinin__InfluenzaA__ABC40619
augaagaccaucaucgcccucuccuacaucuucugccucguccucggccaggacuucuccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucuccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92024 - RNA, 1698 nt, Artificial Sequence
  derived and/or modified sequence opt2 from hemagglutinin__InfluenzaA__ABC40631
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92025 - RNA, 1701 nt, Artificial Sequence
  derived and/or modified sequence opt2 from hemagglutinin__InfluenzaA__ABC41692
augaagaccaucaucgcccucuccuacauccucugccucgucuucgcccagaagccccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92026 - RNA, 1698 nt, Artificial Sequence; identical to SEQ ID NO: 91811
  derived and/or modified sequence opt2 from hemagglutinin__InfluenzaA__ABC41714

SEQ ID NO: 92027 - RNA, 1701 nt, Artificial Sequence
  derived and/or modified sequence opt2 from hemagglutinin__InfluenzaA__ABC41725
augaagaccaccaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92028 - RNA, 1701 nt, Artificial Sequence
  derived and/or modified sequence opt2 from hemagglutinin__InfluenzaA__ABC41736
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92029 - RNA, 1701 nt, Artificial Sequence; identical to SEQ ID NO: 92028
  derived and/or modified sequence opt2 from hemagglutinin__InfluenzaA__ABC41952

SEQ ID NO: 92030 - RNA, 1701 nt, Artificial Sequence; identical to SEQ ID NO: 92028
  derived and/or modified sequence opt2 from hemagglutinin__InfluenzaA__ABC41953

SEQ ID NO: 92031 - RNA, 1701 nt, Artificial Sequence; identical to SEQ ID NO: 92028
  derived and/or modified sequence opt2 from hemagglutinin__InfluenzaA__ABC41964

SEQ ID NO: 92032 - RNA, 1701 nt, Artificial Sequence; identical to SEQ ID NO: 92028
  derived and/or modified sequence opt2 from hemagglutinin__InfluenzaA__ABC42014

SEQ ID NO: 92033 - RNA, 1701 nt, Artificial Sequence; identical to SEQ ID NO: 92028
  derived and/or modified sequence opt2 from hemagglutinin__InfluenzaA__ABC42114

SEQ ID NO: 92034 - RNA, 1701 nt, Artificial Sequence; identical to SEQ ID NO: 92028
  derived and/or modified sequence opt2 from hemagglutinin__InfluenzaA__ABC42125

SEQ ID NO: 92035 - RNA, 1701 nt, Artificial Sequence; identical to SEQ ID NO: 92028
  derived and/or modified sequence opt2 from hemagglutinin__InfluenzaA__ABC42136

SEQ ID NO: 92036 - RNA, 1701 nt, Artificial Sequence
  derived and/or modified sequence opt2 from hemagglutinin__InfluenzaA__ABC42147
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacguccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92037 - RNA, 1701 nt, Artificial Sequence; identical to SEQ ID NO: 92028
  derived and/or modified sequence opt2 from hemagglutinin__InfluenzaA__ABC42158

SEQ ID NO: 92038 - RNA, 1701 nt, Artificial Sequence; identical to SEQ ID NO: 92028
  derived and/or modified sequence opt2 from hemagglutinin__InfluenzaA__ABC42169

SEQ ID NO: 92039 - RNA, 1701 nt, Artificial Sequence; identical to SEQ ID NO: 92028
  derived and/or modified sequence opt2 from hemagglutinin__InfluenzaA__ABC42180

SEQ ID NO: 92040 - RNA, 1701 nt, Artificial Sequence; identical to SEQ ID NO: 92028
  derived and/or modified sequence opt2 from hemagglutinin__InfluenzaA__ABC42192

SEQ ID NO: 92041 - RNA, 1701 nt, Artificial Sequence; identical to SEQ ID NO: 92028
  derived and/or modified sequence opt2 from hemagglutinin__InfluenzaA__ABC42307

SEQ ID NO: 92042 - RNA, 1701 nt, Artificial Sequence
  derived and/or modified sequence opt2 from hemagglutinin__InfluenzaA__ABC42318
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92043 - RNA, 1701 nt, Artificial Sequence; identical to SEQ ID NO: 92028
  derived and/or modified sequence opt2 from hemagglutinin__InfluenzaA__ABC42346

SEQ ID NO: 92044 - RNA, 1701 nt, Artificial Sequence; identical to SEQ ID NO: 92028
  derived and/or modified sequence opt2 from hemagglutinin__InfluenzaA__ABC42461

SEQ ID NO: 92045 - RNA, 1701 nt, Artificial Sequence; identical to SEQ ID NO: 92028
  derived and/or modified sequence opt2 from hemagglutinin__InfluenzaA__ABC42494

SEQ ID NO: 92046 - RNA, 1701 nt, Artificial Sequence; identical to SEQ ID NO: 92028
  derived and/or modified sequence opt2 from hemagglutinin__InfluenzaA__ABC42505

SEQ ID NO: 92047 - RNA, 1701 nt, Artificial Sequence
  derived and/or modified sequence opt2 from hemagglutinin__InfluenzaA__ABC42516
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92048 - RNA, 1701 nt, Artificial Sequence; identical to SEQ ID NO: 92028
  derived and/or modified sequence opt2 from hemagglutinin__InfluenzaA__ABC42527

SEQ ID NO: 92049 - RNA, 1701 nt, Artificial Sequence; identical to SEQ ID NO: 92028
  derived and/or modified sequence opt2 from hemagglutinin__InfluenzaA__ABC42574

SEQ ID NO: 92050 - RNA, 1701 nt, Artificial Sequence; identical to SEQ ID NO: 92028
  derived and/or modified sequence opt2 from hemagglutinin__InfluenzaA__ABC42585

SEQ ID NO: 92051 - RNA, 1701 nt, Artificial Sequence; identical to SEQ ID NO: 91755
  derived and/or modified sequence opt2 from hemagglutinin__InfluenzaA__ABC42596

SEQ ID NO: 92052 - RNA, 1701 nt, Artificial Sequence; identical to SEQ ID NO: 91794
  derived and/or modified sequence opt2 from hemagglutinin__InfluenzaA__ABC42607

SEQ ID NO: 92053 - RNA, 1701 nt, Artificial Sequence; identical to SEQ ID NO: 91794
  derived and/or modified sequence opt2 from hemagglutinin__InfluenzaA__ABC42618

SEQ ID NO: 92054 - RNA, 1701 nt, Artificial Sequence
  derived and/or modified sequence opt2 from hemagglutinin__InfluenzaA__ABC42629
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92055 - RNA, 1701 nt, Artificial Sequence
  derived and/or modified sequence opt2 from hemagglutinin__InfluenzaA__ABC42640
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92056 - RNA, 1701 nt, Artificial Sequence; identical to SEQ ID NO: 91755
  derived and/or modified sequence opt2 from hemagglutinin__InfluenzaA__ABC42651

SEQ ID NO: 92057 - RNA, 1701 nt, Artificial Sequence
  derived and/or modified sequence opt2 from hemagglutinin__InfluenzaA__ABC42662
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92058 - RNA, 1701 nt, Artificial Sequence
  derived and/or modified sequence opt2 from hemagglutinin__InfluenzaA__ABC42673
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92059 - RNA, 1701 nt, Artificial Sequence; identical to SEQ ID NO: 91755
  derived and/or modified sequence opt2 from hemagglutinin__InfluenzaA__ABC42684

SEQ ID NO: 92060 - RNA, 1701 nt, Artificial Sequence; identical to SEQ ID NO: 91755
  derived and/or modified sequence opt2 from hemagglutinin__InfluenzaA__ABC42695

SEQ ID NO: 92061 - RNA, 1701 nt, Artificial Sequence
  derived and/or modified sequence opt2 from hemagglutinin__InfluenzaA__ABC42706
augaagaccaucaucgcccucuccuacauccucugccucgucuucgcccagaagcuccccggcaacgacaacuccaccgccacccucugccucggccaccacgccguccccaacggcaccaccgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92062 - RNA, 1701 nt, Artificial Sequence; identical to SEQ ID NO: 91755
  derived and/or modified sequence opt2 from hemagglutinin__InfluenzaA__ABC42717

SEQ ID NO: 92063 - RNA, 1701 nt, Artificial Sequence
  derived and/or modified sequence opt2 from hemagglutinin__InfluenzaA__ABC42728
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucauggacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92064 - RNA, 1701 nt, Artificial Sequence; identical to SEQ ID NO: 91755
  derived and/or modified sequence opt2 from hemagglutinin__InfluenzaA__ABC42739

SEQ ID NO: 92065 - RNA, 1698 nt, Artificial Sequence
  derived and/or modified sequence opt2 from hemagglutinin__InfluenzaA__ABC42750
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92066 - RNA, 1701 nt, Artificial Sequence; identical to SEQ ID NO: 91755
  derived and/or modified sequence opt2 from hemagglutinin__InfluenzaA__ABC42761

SEQ ID NO: 92067 - RNA, 1701 nt, Artificial Sequence
  derived and/or modified sequence opt2 from hemagglutinin__InfluenzaA__ABC42772
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92068 - RNA, 1701 nt, Artificial Sequence; identical to SEQ ID NO: 91755
  derived and/or modified sequence opt2 from hemagglutinin__InfluenzaA__ABC42783

SEQ ID NO: 92069 - RNA, 1701 nt, Artificial Sequence; identical to SEQ ID NO: 91755
  derived and/or modified sequence opt2 from hemagglutinin__InfluenzaA__ABC42794

SEQ ID NO: 92070 - RNA, 1701 nt, Artificial Sequence; identical to SEQ ID NO: 91755
  derived and/or modified sequence opt2 from hemagglutinin__InfluenzaA__ABC42805

SEQ ID NO: 92071 - RNA, 1701 nt, Artificial Sequence; identical to SEQ ID NO: 91794
  derived and/or modified sequence opt2 from hemagglutinin__InfluenzaA__ABC42816

SEQ ID NO: 92072 - RNA, 1701 nt, Artificial Sequence
  derived and/or modified sequence opt2 from hemagglutinin__InfluenzaA__ABC42827
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcauguccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92073 - RNA, 1701 nt, Artificial Sequence; identical to SEQ ID NO: 91755
  derived and/or modified sequence opt2 from hemagglutinin__InfluenzaA__ABC42849

SEQ ID NO: 92074 - RNA, 1701 nt, Artificial Sequence
  derived and/or modified sequence opt2 from hemagglutinin__InfluenzaA__ABC42882
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92075 - RNA, 1701 nt, Artificial Sequence; identical to SEQ ID NO: 92074
  derived and/or modified sequence opt2 from hemagglutinin__InfluenzaA__ABC42893

SEQ ID NO: 92076 - RNA, 1701 nt, Artificial Sequence; identical to SEQ ID NO: 92028
  derived and/or modified sequence opt2 from hemagglutinin__InfluenzaA__ABC42929

SEQ ID NO: 92077 - RNA, 1701 nt, Artificial Sequence; identical to SEQ ID NO: 92028
  derived and/or modified sequence opt2 from hemagglutinin__InfluenzaA__ABC42940

SEQ ID NO: 92078 - RNA, 1701 nt, Artificial Sequence; identical to SEQ ID NO: 92028
  derived and/or modified sequence opt2 from hemagglutinin__InfluenzaA__ABC42951

SEQ ID NO: 92079 - RNA, 1701 nt, Artificial Sequence; identical to SEQ ID NO: 92028
  derived and/or modified sequence opt2 from hemagglutinin__InfluenzaA__ABC42962

SEQ ID NO: 92080 - RNA, 1701 nt, Artificial Sequence; identical to SEQ ID NO: 92028
  derived and/or modified sequence opt2 from hemagglutinin__InfluenzaA__ABC42973

SEQ ID NO: 92081 - RNA, 1701 nt, Artificial Sequence; identical to SEQ ID NO: 92028
  derived and/or modified sequence opt2 from hemagglutinin__InfluenzaA__ABC42995

SEQ ID NO: 92082 - RNA, 1701 nt, Artificial Sequence; identical to SEQ ID NO: 92028
  derived and/or modified sequence opt2 from hemagglutinin__InfluenzaA__ABC43006

SEQ ID NO: 92083 - RNA, 1701 nt, Artificial Sequence; identical to SEQ ID NO: 92028
  derived and/or modified sequence opt2 from hemagglutinin__InfluenzaA__ABC43028

SEQ ID NO: 92084 - RNA, 1701 nt, Artificial Sequence; identical to SEQ ID NO: 92028
  derived and/or modified sequence opt2 from hemagglutinin__InfluenzaA__ABC43039

SEQ ID NO: 92085 - RNA, 1701 nt, Artificial Sequence; identical to SEQ ID NO: 92028
  derived and/or modified sequence opt2 from hemagglutinin__InfluenzaA__ABC43050

SEQ ID NO: 92086 - RNA, 1701 nt, Artificial Sequence; identical to SEQ ID NO: 92028
  derived and/or modified sequence opt2 from hemagglutinin__InfluenzaA__ABC43061

SEQ ID NO: 92087 - RNA, 1701 nt, Artificial Sequence
  derived and/or modified sequence opt2 from hemagglutinin__InfluenzaA__ABC43072
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggccugccagaagggcaacauccgcugcaacaucugcaucuga

SEQ ID NO: 92088 - RNA, 1701 nt, Artificial Sequence; identical to SEQ ID NO: 92028
  derived and/or modified sequence opt2 from hemagglutinin__InfluenzaA__ABC43083

SEQ ID NO: 92089 - RNA, 1701 nt, Artificial Sequence; identical to SEQ ID NO: 92028
  derived and/or modified sequence opt2 from hemagglutinin__InfluenzaA__ABC43094

SEQ ID NO: 92090 - RNA, 1701 nt, Artificial Sequence; identical to SEQ ID NO: 92028
  derived and/or modified sequence opt2 from hemagglutinin__InfluenzaA__ABC43116

SEQ ID NO: 92091 - RNA, 1701 nt, Artificial Sequence; identical to SEQ ID NO: 91755
  derived and/or modified sequence opt2 from hemagglutinin__InfluenzaA__ABC43127

SEQ ID NO: 92092 - RNA, 1701 nt, Artificial Sequence; identical to SEQ ID NO: 91794
  derived and/or modified sequence opt2 from hemagglutinin__InfluenzaA__ABC43138

SEQ ID NO: 92093 - RNA, 1701 nt, Artificial Sequence; identical to SEQ ID NO: 91755
  derived and/or modified sequence opt2 from hemagglutinin__InfluenzaA__ABC43149

SEQ ID NO: 92094 - RNA, 1701 nt, Artificial Sequence; identical to SEQ ID NO: 91755
  derived and/or modified sequence opt2 from hemagglutinin__InfluenzaA__ABC43160

SEQ ID NO: 92095 - RNA, 1701 nt, Artificial Sequence; identical to SEQ ID NO: 91755
  derived and/or modified sequence opt2 from hemagglutinin__InfluenzaA__ABC43171

SEQ ID NO: 92096 - RNA, 1701 nt, Artificial Sequence; identical to SEQ ID NO: 91755
  derived and/or modified sequence opt2 from hemagglutinin__InfluenzaA__ABC43182

SEQ ID NO: 92097 - RNA, 1701 nt, Artificial Sequence
  derived and/or modified sequence opt2 from hemagglutinin__InfluenzaA__ABC43475
augaagaccaucaucgcccucuccuacauccucugccucgucuucgcccagaagcuccccggcaacgacaacuccaccgccacccucugccucggccaccacgccguccccaacggcaccaccgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92098 - RNA, 1701 nt, Artificial Sequence; identical to SEQ ID NO: 91755
  derived and/or modified sequence opt2 from hemagglutinin__InfluenzaA__ABC43486

SEQ ID NO: 92099 - RNA, 1701 nt, Artificial Sequence; identical to SEQ ID NO: 91755
  derived and/or modified sequence opt2 from hemagglutinin__InfluenzaA__ABC43497

SEQ ID NO: 92100 - RNA, 1701 nt, Artificial Sequence; identical to SEQ ID NO: 91794
  derived and/or modified sequence opt2 from hemagglutinin__InfluenzaA__ABC43508

SEQ ID NO: 92101 - RNA, 1701 nt, Artificial Sequence; identical to SEQ ID NO: 91794
  derived and/or modified sequence opt2 from hemagglutinin__InfluenzaA__ABC43519

SEQ ID NO: 92102 - RNA, 1701 nt, Artificial Sequence; identical to SEQ ID NO: 91794
  derived and/or modified sequence opt2 from hemagglutinin__InfluenzaA__ABC43530

SEQ ID NO: 92103 - RNA, 1701 nt, Artificial Sequence
  derived and/or modified sequence opt2 from hemagglutinin__InfluenzaA__ABC43552
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggcccccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92104 - RNA, 1701 nt, Artificial Sequence
  derived and/or modified sequence opt2 from hemagglutinin__InfluenzaA__ABC46554
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaggacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92105 - RNA, 1701 nt, Artificial Sequence
  derived and/or modified sequence opt2 from hemagglutinin__InfluenzaA__ABC46576
augaagaccaucaucgcccucuccuacaucuucugccucgucuucgcccagaaccuccccggcaacgacaaguccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucgucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgaguccuucaacuggaccggcgucacccaguccggcggcuccuacgccugcaagcgcggcuccgacaacuccuucuucucccgccucaacuggcucuacgaguccgaguccaaguaccccguccucaacgucaccaugcccaacaacggcaacuucgacaagcucuacaucuggggcguccaccaccccuccaccgacaaggagcagaccaaccucuacguccgcgccuccggccgcgucaccgucuccaccaagcgcucccagcagaccaucauccccaacaucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92106 - RNA, 1701 nt, Artificial Sequence; identical to SEQ ID NO: 91964
  derived and/or modified sequence opt2 from hemagglutinin__InfluenzaA__ABC50167

SEQ ID NO: 92107 - RNA, 1701 nt, Artificial Sequence; identical to SEQ ID NO: 91964
  derived and/or modified sequence opt2 from hemagglutinin__InfluenzaA__ABC50178

SEQ ID NO: 92108 - RNA, 1701 nt, Artificial Sequence; identical to SEQ ID NO: 91964
  derived and/or modified sequence opt2 from hemagglutinin__InfluenzaA__ABC50189

SEQ ID NO: 92109 - RNA, 1701 nt, Artificial Sequence; identical to SEQ ID NO: 92074
  derived and/or modified sequence opt2 from hemagglutinin__InfluenzaA__ABC50200

SEQ ID NO: 92110 - RNA, 1701 nt, Artificial Sequence; identical to SEQ ID NO: 92074
  derived and/or modified sequence opt2 from hemagglutinin__InfluenzaA__ABC50211

SEQ ID NO: 92111 - RNA, 1701 nt, Artificial Sequence; identical to SEQ ID NO: 92074
  derived and/or modified sequence opt2 from hemagglutinin__InfluenzaA__ABC50222

SEQ ID NO: 92112 - RNA, 1701 nt, Artificial Sequence; identical to SEQ ID NO: 92074
  derived and/or modified sequence opt2 from hemagglutinin__InfluenzaA__ABC50233

SEQ ID NO: 92113 - RNA, 1701 nt, Artificial Sequence; identical to SEQ ID NO: 92074
  derived and/or modified sequence opt2 from hemagglutinin__InfluenzaA__ABC50244

SEQ ID NO: 92114 - RNA, 1701 nt, Artificial Sequence; identical to SEQ ID NO: 92074
  derived and/or modified sequence opt2 from hemagglutinin__InfluenzaA__ABC50266

SEQ ID NO: 92115 - RNA, 1701 nt, Artificial Sequence; identical to SEQ ID NO: 92074
  derived and/or modified sequence opt2 from hemagglutinin__InfluenzaA__ABC50277

SEQ ID NO: 92116 - RNA, 1701 nt, Artificial Sequence
  derived and/or modified sequence opt2 from hemagglutinin__InfluenzaA__ABC50299
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaccuccugcuuccuccucugcaucguccuccucggcuucaucaugugggccugccagaagggcaacauccgcugcaacaucugcaucuga

SEQ ID NO: 92117 - RNA, 1701 nt, Artificial Sequence; identical to SEQ ID NO: 92074
  derived and/or modified sequence opt2 from hemagglutinin__InfluenzaA__ABC50310

SEQ ID NO: 92118 - RNA, 1701 nt, Artificial Sequence
  derived and/or modified sequence opt2 from hemagglutinin__InfluenzaA__ABC50321
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccggcaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92119 - RNA, 1701 nt, Artificial Sequence
  derived and/or modified sequence opt2 from hemagglutinin__InfluenzaA__ABC50332
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92120 - RNA, 1701 nt, Artificial Sequence; identical to SEQ ID NO: 92074
  derived and/or modified sequence opt2 from hemagglutinin__InfluenzaA__ABC50343

SEQ ID NO: 92121 - RNA, 1701 nt, Artificial Sequence
  derived and/or modified sequence opt2 from hemagglutinin__InfluenzaA__ABC50354
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccuccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92122 - RNA, 1701 nt, Artificial Sequence
  derived and/or modified sequence opt2 from hemagglutinin__InfluenzaA__ABC50376
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaccggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92123 - RNA, 1701 nt, Artificial Sequence
  derived and/or modified sequence opt2 from hemagglutinin__InfluenzaA__ABC50387
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacgucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92124 - RNA, 1701 nt, Artificial Sequence
  derived and/or modified sequence opt2 from hemagglutinin__InfluenzaA__ABC50409
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92125 - RNA, 1701 nt, Artificial Sequence; identical to SEQ ID NO: 92124
  derived and/or modified sequence opt2 from hemagglutinin__InfluenzaA__ABC50420

SEQ ID NO: 92126 - RNA, 1701 nt, Artificial Sequence
  derived and/or modified sequence opt2 from hemagglutinin__InfluenzaA__ABC54668
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcucccuccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92127 - RNA, 1701 nt, Artificial Sequence
  derived and/or modified sequence opt2 from hemagglutinin__InfluenzaA__ABC54679
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccucccccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacgucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92128 - RNA, 1701 nt, Artificial Sequence; identical to SEQ ID NO: 92028
  derived and/or modified sequence opt2 from hemagglutinin__InfluenzaA__ABC67319

SEQ ID NO: 92129 - RNA, 1701 nt, Artificial Sequence
  derived and/or modified sequence opt2 from hemagglutinin__InfluenzaA__ABC67454
augaagaccaucaucgcccucuccuacauccucugccucgucuucgcccaggagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92130 - RNA, 1701 nt, Artificial Sequence; identical to SEQ ID NO: 92074
  derived and/or modified sequence opt2 from hemagglutinin__InfluenzaA__ABC67471

SEQ ID NO: 92131 - RNA, 1701 nt, Artificial Sequence
  derived and/or modified sequence opt2 from hemagglutinin__InfluenzaA__ABC67554
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgucaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92132 - RNA, 1701 nt, Artificial Sequence
  derived and/or modified sequence opt2 from hemagglutinin__InfluenzaA__ABC67565
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacaucggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92133 - RNA, 1701 nt, Artificial Sequence
  derived and/or modified sequence opt2 from hemagglutinin__InfluenzaA__ABC67576
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaucaaguccuucuucucccgccucaacuggcuccaccagcucaaguacaaguaccccgcccucaacgucaccaugcccaacaacgacgaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92134 - RNA, 1701 nt, Artificial Sequence
  derived and/or modified sequence opt2 from hemagglutinin__InfluenzaA__ABC67587
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92135 - RNA, 1701 nt, Artificial Sequence; identical to SEQ ID NO: 91755
  derived and/or modified sequence opt2 from hemagglutinin__InfluenzaA__ABC67598

SEQ ID NO: 92136 - RNA, 1701 nt, Artificial Sequence; identical to SEQ ID NO: 92074
  derived and/or modified sequence opt2 from hemagglutinin__InfluenzaA__ABC67609

SEQ ID NO: 92137 - RNA, 1701 nt, Artificial Sequence; identical to SEQ ID NO: 92074
  derived and/or modified sequence opt2 from hemagglutinin__InfluenzaA__ABC67620

SEQ ID NO: 92138 - RNA, 1701 nt, Artificial Sequence; identical to SEQ ID NO: 92074
  derived and/or modified sequence opt2 from hemagglutinin__InfluenzaA__ABC67631

SEQ ID NO: 92139 - RNA, 1701 nt, Artificial Sequence; identical to SEQ ID NO: 92074
  derived and/or modified sequence opt2 from hemagglutinin__InfluenzaA__ABC67642

SEQ ID NO: 92140 - RNA, 1701 nt, Artificial Sequence
  derived and/or modified sequence opt2 from hemagglutinin__InfluenzaA__ABC67653
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcgucguccuccucggcuucaucaugugggccugccagaagggcaacauccgcugcaacaucugcaucuga

SEQ ID NO: 92141 - RNA, 1701 nt, Artificial Sequence
  derived and/or modified sequence opt2 from hemagglutinin__InfluenzaA__ABC67697
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92142 - RNA, 1701 nt, Artificial Sequence
  derived and/or modified sequence opt2 from hemagglutinin__InfluenzaA__ABC67708
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92143 - RNA, 1701 nt, Artificial Sequence; identical to SEQ ID NO: 92142
  derived and/or modified sequence opt2 from hemagglutinin__InfluenzaA__ABC67719

SEQ ID NO: 92144 - RNA, 1701 nt, Artificial Sequence; identical to SEQ ID NO: 92142
  derived and/or modified sequence opt2 from hemagglutinin__InfluenzaA__ABC67733

SEQ ID NO: 92145 - RNA, 1701 nt, Artificial Sequence
  derived and/or modified sequence opt2 from hemagglutinin__InfluenzaA__ABC67806
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92146 - RNA, 1701 nt, Artificial Sequence; identical to SEQ ID NO: 92028
  derived and/or modified sequence opt2 from hemagglutinin__InfluenzaA__ABC67817

SEQ ID NO: 92147 - RNA, 1701 nt, Artificial Sequence; identical to SEQ ID NO: 92142
  derived and/or modified sequence opt2 from hemagglutinin__InfluenzaA__ABC67828

SEQ ID NO: 92148 - RNA, 1701 nt, Artificial Sequence; identical to SEQ ID NO: 92006
  derived and/or modified sequence opt2 from hemagglutinin__InfluenzaA__ABC67839

SEQ ID NO: 92149 - RNA, 1701 nt, Artificial Sequence
  derived and/or modified sequence opt2 from hemagglutinin__InfluenzaA__ABC67850
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccugggcccgcggcgucuccucccgcaucuccauccacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92150 - RNA, 1701 nt, Artificial Sequence; identical to SEQ ID NO: 92006
  derived and/or modified sequence opt2 from hemagglutinin__InfluenzaA__ABC67861

SEQ ID NO: 92151 - RNA, 1701 nt, Artificial Sequence; identical to SEQ ID NO: 92074
  derived and/or modified sequence opt2 from hemagglutinin__InfluenzaA__ABC67883

SEQ ID NO: 92152 - RNA, 1701 nt, Artificial Sequence
  derived and/or modified sequence opt2 from hemagglutinin__InfluenzaA__ABC67894
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucuccaagcucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92153 - RNA, 1701 nt, Artificial Sequence; identical to SEQ ID NO: 92074
  derived and/or modified sequence opt2 from hemagglutinin__InfluenzaA__ABC67967

SEQ ID NO: 92154 - RNA, 1701 nt, Artificial Sequence; identical to SEQ ID NO: 92074
  derived and/or modified sequence opt2 from hemagglutinin__InfluenzaA__ABC67978

SEQ ID NO: 92155 - RNA, 1701 nt, Artificial Sequence
  derived and/or modified sequence opt2 from hemagglutinin__InfluenzaA__ABC67989
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaaggucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92156 - RNA, 1701 nt, Artificial Sequence; identical to SEQ ID NO: 92129
  derived and/or modified sequence opt2 from hemagglutinin__InfluenzaA__ABC68000

SEQ ID NO: 92157 - RNA, 1701 nt, Artificial Sequence
  derived and/or modified sequence opt2 from hemagglutinin__InfluenzaA__ABC68049
augaagaccaucaucgcccucuccuacauccucugccucgucuucgcccagaagcuccccggcaacgacaacuccaccgccacccucugccucggccaccacgccguccccaacggcacccucgucaagaccaucaccgacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacgucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92158 - RNA, 1701 nt, Artificial Sequence; identical to SEQ ID NO: 92074
  derived and/or modified sequence opt2 from hemagglutinin__InfluenzaA__ABC68060

SEQ ID NO: 92159 - RNA, 1701 nt, Artificial Sequence
  derived and/or modified sequence opt2 from hemagglutinin__InfluenzaA__ABC68071
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92160 - RNA, 1701 nt, Artificial Sequence; identical to SEQ ID NO: 92142
  derived and/or modified sequence opt2 from hemagglutinin__InfluenzaA__ABC68082

SEQ ID NO: 92161 - RNA, 1701 nt, Artificial Sequence
  derived and/or modified sequence opt2 from hemagglutinin__InfluenzaA__ABC68093
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcaucguccuccucggcuucaucaugugggccugccagaagggcaacauccgcugcaacaucugcaucuga

SEQ ID NO: 92162 - RNA, 1701 nt, Artificial Sequence
  derived and/or modified sequence opt2 from hemagglutinin__InfluenzaA__ABC68222
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92163 - RNA, 1701 nt, Artificial Sequence; identical to SEQ ID NO: 91954
  derived and/or modified sequence opt2 from hemagglutinin__InfluenzaA__ABC68233

SEQ ID NO: 92164 - RNA, 1707 nt, Artificial Sequence
  derived and/or modified sequence opt2 from hemagglutinin__InfluenzaA__ABC72655
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaagcccaaccccgccaacgaccucugcuaccccggcgacuucaacgacuacgaggagcucaagcaccuccucucccgcaucaaccacuucgagaagauccagaucauccccaaguccuccugguccucccacgaggccuccgucggcgucuccuccgucugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 92165 - RNA, 1701 nt, Artificial Sequence; identical to SEQ ID NO: 91755
  derived and/or modified sequence opt2 from hemagglutinin__InfluenzaA__ABC84400

SEQ ID NO: 92166 - RNA, 1701 nt, Artificial Sequence; identical to SEQ ID NO: 91964
  derived and/or modified sequence opt2 from hemagglutinin__InfluenzaA__ABC84411

SEQ ID NO: 92167 - RNA, 1701 nt, Artificial Sequence
  derived and/or modified sequence opt2 from hemagglutinin__InfluenzaA__ABC84433
augaagaccaucaucgcccucuccuacauccucugccucgucuucgcccagaagcuccccggcaacgacaaccgcaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92168 - RNA, 1701 nt, Artificial Sequence; identical to SEQ ID NO: 92074
  derived and/or modified sequence opt2 from hemagglutinin__InfluenzaA__ABC84444

SEQ ID NO: 92169 - RNA, 1701 nt, Artificial Sequence; identical to SEQ ID NO: 92145
  derived and/or modified sequence opt2 from hemagglutinin__InfluenzaA__ABC84498

SEQ ID NO: 92170 - RNA, 1701 nt, Artificial Sequence; identical to SEQ ID NO: 92145
  derived and/or modified sequence opt2 from hemagglutinin__InfluenzaA__ABC84509

SEQ ID NO: 92171 - RNA, 1701 nt, Artificial Sequence
  derived and/or modified sequence opt2 from hemagglutinin__InfluenzaA__ABC84520
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92172 - RNA, 1701 nt, Artificial Sequence
  derived and/or modified sequence opt2 from hemagglutinin__InfluenzaA__ABC84531
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccgcccucaacgucaccaugcccaacaacggccgcuucgacaagcucuacaucuggggcguccaccaccccuccaccgacaaggagcagaccaaccucuacguccgcgccgccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92173 - RNA, 1701 nt, Artificial Sequence; identical to SEQ ID NO: 92162
  derived and/or modified sequence opt2 from hemagglutinin__InfluenzaA__ABC84560

SEQ ID NO: 92174 - RNA, 1701 nt, Artificial Sequence
  derived and/or modified sequence opt2 from hemagglutinin__InfluenzaA__ABC84571
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagaucaucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92175 - RNA, 1701 nt, Artificial Sequence; identical to SEQ ID NO: 92162
  derived and/or modified sequence opt2 from hemagglutinin__InfluenzaA__ABC85754

SEQ ID NO: 92176 - RNA, 1701 nt, Artificial Sequence; identical to SEQ ID NO: 92142
  derived and/or modified sequence opt2 from hemagglutinin__InfluenzaA__ABC85765

SEQ ID NO: 92177 - RNA, 1701 nt, Artificial Sequence
  derived and/or modified sequence opt2 from hemagglutinin__InfluenzaA__ABC85776
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuucaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92178 - RNA, 1701 nt, Artificial Sequence; identical to SEQ ID NO: 92162
  derived and/or modified sequence opt2 from hemagglutinin__InfluenzaA__ABC85787

SEQ ID NO: 92179 - RNA, 1701 nt, Artificial Sequence; identical to SEQ ID NO: 92145
  derived and/or modified sequence opt2 from hemagglutinin__InfluenzaA__ABC85798

SEQ ID NO: 92180 - RNA, 1701 nt, Artificial Sequence; identical to SEQ ID NO: 92142
  derived and/or modified sequence opt2 from hemagglutinin__InfluenzaA__ABC85820

SEQ ID NO: 92181 - RNA, 1701 nt, Artificial Sequence; identical to SEQ ID NO: 92142
  derived and/or modified sequence opt2 from hemagglutinin__InfluenzaA__ABC85831

SEQ ID NO: 92182 - RNA, 1701 nt, Artificial Sequence; identical to SEQ ID NO: 92145
  derived and/or modified sequence opt2 from hemagglutinin__InfluenzaA__ABC85842

SEQ ID NO: 92183 - RNA, 1701 nt, Artificial Sequence; identical to SEQ ID NO: 92142
  derived and/or modified sequence opt2 from hemagglutinin__InfluenzaA__ABC85853

SEQ ID NO: 92184 - RNA, 1701 nt, Artificial Sequence; identical to SEQ ID NO: 92142
  derived and/or modified sequence opt2 from hemagglutinin__InfluenzaA__ABC85864

SEQ ID NO: 92185 - RNA, 1701 nt, Artificial Sequence; identical to SEQ ID NO: 92145
  derived and/or modified sequence opt2 from hemagglutinin__InfluenzaA__ABC85886

SEQ ID NO: 92186 - RNA, 1701 nt, Artificial Sequence; identical to SEQ ID NO: 92074
  derived and/or modified sequence opt2 from hemagglutinin__InfluenzaA__ABC85908

SEQ ID NO: 92187 - RNA, 1701 nt, Artificial Sequence
  derived and/or modified sequence opt2 from hemagglutinin__InfluenzaA__ABC85919
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccucaugggcuucaucaugugggccugccagaagggcaacauccgcugcaacaucugcaucuga

SEQ ID NO: 92188 - RNA, 1701 nt, Artificial Sequence; identical to SEQ ID NO: 92074
  derived and/or modified sequence opt2 from hemagglutinin__InfluenzaA__ABC85930

SEQ ID NO: 92189 - RNA, 1701 nt, Artificial Sequence; identical to SEQ ID NO: 92123
  derived and/or modified sequence opt2 from hemagglutinin__InfluenzaA__ABC85941

SEQ ID NO: 92190 - RNA, 1701 nt, Artificial Sequence
  derived and/or modified sequence opt2 from hemagglutinin__InfluenzaA__ABC85952
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccacaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92191 - RNA, 1701 nt, Artificial Sequence; identical to SEQ ID NO: 92074
  derived and/or modified sequence opt2 from hemagglutinin__InfluenzaA__ABC85974

SEQ ID NO: 92192 - RNA, 1701 nt, Artificial Sequence; identical to SEQ ID NO: 92074
  derived and/or modified sequence opt2 from hemagglutinin__InfluenzaA__ABC85985

SEQ ID NO: 92193 - RNA, 1701 nt, Artificial Sequence
  derived and/or modified sequence opt2 from hemagglutinin__InfluenzaA__ABC85996
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92194 - RNA, 1701 nt, Artificial Sequence; identical to SEQ ID NO: 91755
  derived and/or modified sequence opt2 from hemagglutinin__InfluenzaA__ABC86007

SEQ ID NO: 92195 - RNA, 1701 nt, Artificial Sequence
  derived and/or modified sequence opt2 from hemagglutinin__InfluenzaA__ABC86018
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcaccaucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92196 - RNA, 1701 nt, Artificial Sequence; identical to SEQ ID NO: 91755
  derived and/or modified sequence opt2 from hemagglutinin__InfluenzaA__ABC86029

SEQ ID NO: 92197 - RNA, 1701 nt, Artificial Sequence; identical to SEQ ID NO: 91794
  derived and/or modified sequence opt2 from hemagglutinin__InfluenzaA__ABC86040

SEQ ID NO: 92198 - RNA, 1701 nt, Artificial Sequence; identical to SEQ ID NO: 92028
  derived and/or modified sequence opt2 from hemagglutinin__InfluenzaA__ABC86124

SEQ ID NO: 92199 - RNA, 1701 nt, Artificial Sequence; identical to SEQ ID NO: 92105
  derived and/or modified sequence opt2 from hemagglutinin__InfluenzaA__ABC86137

SEQ ID NO: 92200 - RNA, 1701 nt, Artificial Sequence
  derived and/or modified sequence opt2 from hemagglutinin__InfluenzaA__ABC97374
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92201 - RNA, 1701 nt, Artificial Sequence; identical to SEQ ID NO: 91544
  derived and/or modified sequence opt2 from hemagglutinin__InfluenzaA__ABD15449

SEQ ID NO: 92202 - RNA, 1701 nt, Artificial Sequence
  derived and/or modified sequence opt2 from hemagglutinin__InfluenzaA__ABD15460
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacucccccuaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92203 - RNA, 1701 nt, Artificial Sequence; identical to SEQ ID NO: 91544
  derived and/or modified sequence opt2 from hemagglutinin__InfluenzaA__ABD15471

SEQ ID NO: 92204 - RNA, 1701 nt, Artificial Sequence; identical to SEQ ID NO: 91544
  derived and/or modified sequence opt2 from hemagglutinin__InfluenzaA__ABD15482

SEQ ID NO: 92205 - RNA, 1701 nt, Artificial Sequence; identical to SEQ ID NO: 92202
  derived and/or modified sequence opt2 from hemagglutinin__InfluenzaA__ABD15493

SEQ ID NO: 92206 - RNA, 1701 nt, Artificial Sequence; identical to SEQ ID NO: 91755
  derived and/or modified sequence opt2 from hemagglutinin__InfluenzaA__ABD15526

SEQ ID NO: 92207 - RNA, 1701 nt, Artificial Sequence; identical to SEQ ID NO: 91964
  derived and/or modified sequence opt2 from hemagglutinin__InfluenzaA__ABD15537

SEQ ID NO: 92208 - RNA, 1701 nt, Artificial Sequence; identical to SEQ ID NO: 91964
  derived and/or modified sequence opt2 from hemagglutinin__InfluenzaA__ABD15548

SEQ ID NO: 92209 - RNA, 1701 nt, Artificial Sequence; identical to SEQ ID NO: 91982
  derived and/or modified sequence opt2 from hemagglutinin__InfluenzaA__ABD15559

SEQ ID NO: 92210 - RNA, 1701 nt, Artificial Sequence; identical to SEQ ID NO: 91964
  derived and/or modified sequence opt2 from hemagglutinin__InfluenzaA__ABD15570

SEQ ID NO: 92211 - RNA, 1701 nt, Artificial Sequence; identical to SEQ ID NO: 91982
  derived and/or modified sequence opt2 from hemagglutinin__InfluenzaA__ABD15581

SEQ ID NO: 92212 - RNA, 1701 nt, Artificial Sequence; identical to SEQ ID NO: 91964
  derived and/or modified sequence opt2 from hemagglutinin__InfluenzaA__ABD15592

SEQ ID NO: 92213 - RNA, 1701 nt, Artificial Sequence; identical to SEQ ID NO: 91964
  derived and/or modified sequence opt2 from hemagglutinin__InfluenzaA__ABD15603

SEQ ID NO: 92214 - RNA, 1701 nt, Artificial Sequence; identical to SEQ ID NO: 91964
  derived and/or modified sequence opt2 from hemagglutinin__InfluenzaA__ABD15614

SEQ ID NO: 92215 - RNA, 1701 nt, Artificial Sequence
  derived and/or modified sequence opt2 from hemagglutinin__InfluenzaA__ABD15625
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgucaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92216 - RNA, 1701 nt, Artificial Sequence; identical to SEQ ID NO: 91982
  derived and/or modified sequence opt2 from hemagglutinin__InfluenzaA__ABD15636

SEQ ID NO: 92217 - RNA, 1701 nt, Artificial Sequence; identical to SEQ ID NO: 92162
  derived and/or modified sequence opt2 from hemagglutinin__InfluenzaA__ABD15680

SEQ ID NO: 92218 - RNA, 1701 nt, Artificial Sequence
  derived and/or modified sequence opt2 from hemagglutinin__InfluenzaA__ABD15691
augaagaccaucaucgcccucuccuacauccucugccucgucuucgcccagaagcuccccgucaacgacaaguccaccgccacccucugccucggccaccacgccguccccaacggcacccucgucaagaccaucaccaacgaccacaucgaggucaccaacgccaccgagcucguccaguccucccccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92219 - RNA, 1701 nt, Artificial Sequence
  derived and/or modified sequence opt2 from hemagglutinin__InfluenzaA__ABD15702
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaccucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92220 - RNA, 1701 nt, Artificial Sequence
  derived and/or modified sequence opt2 from hemagglutinin__InfluenzaA__ABD15724
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92221 - RNA, 1701 nt, Artificial Sequence
  derived and/or modified sequence opt2 from hemagglutinin__InfluenzaA__ABD15746
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggagaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92222 - RNA, 1701 nt, Artificial Sequence
  derived and/or modified sequence opt2 from hemagglutinin__InfluenzaA__ABD15757
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggagaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92223 - RNA, 1701 nt, Artificial Sequence; identical to SEQ ID NO: 92162
  derived and/or modified sequence opt2 from hemagglutinin__InfluenzaA__ABD15779

SEQ ID NO: 92224 - RNA, 1701 nt, Artificial Sequence; identical to SEQ ID NO: 92162
  derived and/or modified sequence opt2 from hemagglutinin__InfluenzaA__ABD15790

SEQ ID NO: 92225 - RNA, 1701 nt, Artificial Sequence; identical to SEQ ID NO: 92162
  derived and/or modified sequence opt2 from hemagglutinin__InfluenzaA__ABD16292

SEQ ID NO: 92226 - RNA, 1701 nt, Artificial Sequence; identical to SEQ ID NO: 92145
  derived and/or modified sequence opt2 from hemagglutinin__InfluenzaA__ABD16303

SEQ ID NO: 92227 - RNA, 1701 nt, Artificial Sequence; identical to SEQ ID NO: 92145
  derived and/or modified sequence opt2 from hemagglutinin__InfluenzaA__ABD16325

SEQ ID NO: 92228 - RNA, 1701 nt, Artificial Sequence
  derived and/or modified sequence opt2 from hemagglutinin__InfluenzaA__ABD16336
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92229 - RNA, 1701 nt, Artificial Sequence; identical to SEQ ID NO: 92145
  derived and/or modified sequence opt2 from hemagglutinin__InfluenzaA__ABD16347

SEQ ID NO: 92230 - RNA, 1701 nt, Artificial Sequence
  derived and/or modified sequence opt2 from hemagglutinin__InfluenzaA__ABD16358
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgaccucgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92231 - RNA, 1701 nt, Artificial Sequence; identical to SEQ ID NO: 92145
  derived and/or modified sequence opt2 from hemagglutinin__InfluenzaA__ABD16472

SEQ ID NO: 92232 - RNA, 1701 nt, Artificial Sequence; identical to SEQ ID NO: 92145
  derived and/or modified sequence opt2 from hemagglutinin__InfluenzaA__ABD16483

SEQ ID NO: 92233 - RNA, 1701 nt, Artificial Sequence; identical to SEQ ID NO: 92142
  derived and/or modified sequence opt2 from hemagglutinin__InfluenzaA__ABD16494

SEQ ID NO: 92234 - RNA, 1701 nt, Artificial Sequence; identical to SEQ ID NO: 92145
  derived and/or modified sequence opt2 from hemagglutinin__InfluenzaA__ABD16505

SEQ ID NO: 92235 - RNA, 1701 nt, Artificial Sequence
  derived and/or modified sequence opt2 from hemagglutinin__InfluenzaA__ABD16516
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92236 - RNA, 1701 nt, Artificial Sequence
  derived and/or modified sequence opt2 from hemagglutinin__InfluenzaA__ABD16527
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 92237 - RNA, 1701 nt, Artificial Sequence; identical to SEQ ID NO: 92028
  derived and/or modified sequence opt2 from hemagglutinin__InfluenzaA__ABD16538

SEQ ID NO: 92238 - RNA, 1701 nt, Artificial Sequence
  derived and/or modified sequence opt2 from hemagglutinin__InfluenzaA__ABD16549
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucgucugggccugccagaagggcaacauccgcugcaacaucugcaucuga

SEQ ID NO: 92239 - RNA, 1701 nt, Artificial Sequence; identical to SEQ ID NO: 92142
  derived and/or modified sequence opt2 from hemagglutinin__InfluenzaA__ABD16560

SEQ ID NO: 92240 - RNA, 1701 nt, Artificial Sequence
  derived and/or modified sequence opt2 from hemagglutinin__InfluenzaA__ABD16571
augaagaccaucaucgcccucuccuacaucuucugccucgucgucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggccgcaucugcaacuccccccaccgcauccucgacggcaagaacugcacccucaucgacgcccuccucggcgacccccacugcgacuccuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92241 - RNA, 1701 nt, Artificial Sequence
  derived and/or modified sequence opt2 from hemagglutinin__InfluenzaA__ABD16718
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucaucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguacaaguaccccgcccucaacgucaccaugcccaacaacggcaaguucgacaagcucuacaucuggggcguccaccaccccaucaccgagaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92242 - RNA, 1701 nt, Artificial Sequence
  derived and/or modified sequence opt2 from hemagglutinin__InfluenzaA__ABD16729
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacaccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggcaaggucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92243 - RNA, 1701 nt, Artificial Sequence
  derived and/or modified sequence opt2 from hemagglutinin__InfluenzaA__ABD16751
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccacuccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92244 - RNA, 1701 nt, Artificial Sequence; identical to SEQ ID NO: 92105
  derived and/or modified sequence opt2 from hemagglutinin__InfluenzaA__ABD16762

SEQ ID NO: 92245 - RNA, 1701 nt, Artificial Sequence; identical to SEQ ID NO: 91817
  derived and/or modified sequence opt2 from hemagglutinin__InfluenzaA__ABD17323

SEQ ID NO: 92246 - RNA, 1701 nt, Artificial Sequence; identical to SEQ ID NO: 92074
  derived and/or modified sequence opt2 from hemagglutinin__InfluenzaA__ABD38134

SEQ ID NO: 92247 - RNA, 1698 nt, Artificial Sequence; identical to SEQ ID NO: 91813
  derived and/or modified sequence opt2 from hemagglutinin__InfluenzaA__ABD60779

SEQ ID NO: 92248 - RNA, 1701 nt, Artificial Sequence
  derived and/or modified sequence opt2 from hemagglutinin__InfluenzaA__ABD60790
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucaucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92249 - RNA, 1701 nt, Artificial Sequence
  derived and/or modified sequence opt2 from hemagglutinin__InfluenzaA__ABD60801
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgccucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugccgccgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccaguccucccgcauguccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagcacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92250 - RNA, 1701 nt, Artificial Sequence
  derived and/or modified sequence opt2 from hemagglutinin__InfluenzaA__ABD60812
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccuccaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92251 - RNA, 1701 nt, Artificial Sequence; identical to SEQ ID NO: 92145
  derived and/or modified sequence opt2 from hemagglutinin__InfluenzaA__ABD60823

SEQ ID NO: 92252 - RNA, 1701 nt, Artificial Sequence
  derived and/or modified sequence opt2 from hemagglutinin__InfluenzaA__ABD60845
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaccaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucacccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccucaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92253 - RNA, 1698 nt, Artificial Sequence
  derived and/or modified sequence opt2 from hemagglutinin__InfluenzaA__ABD60878
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92254 - RNA, 1698 nt, Artificial Sequence
  derived and/or modified sequence opt2 from hemagglutinin__InfluenzaA__ABD60889
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92255 - RNA, 1698 nt, Artificial Sequence
  derived and/or modified sequence opt2 from hemagglutinin__InfluenzaA__ABD60900
augaaggucaagcgccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92256 - RNA, 1698 nt, Artificial Sequence
  derived and/or modified sequence opt2 from hemagglutinin__InfluenzaA__ABD60911
augaaggccaagcucaugguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92257 - RNA, 1701 nt, Artificial Sequence; identical to SEQ ID NO: 91544
  derived and/or modified sequence opt2 from hemagglutinin__InfluenzaA__ABD60922

SEQ ID NO: 92258 - RNA, 1701 nt, Artificial Sequence
  derived and/or modified sequence opt2 from hemagglutinin__InfluenzaA__ABD60933
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucgucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucaaccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92259 - RNA, 1701 nt, Artificial Sequence
  derived and/or modified sequence opt2 from hemagglutinin__InfluenzaA__ABD60944
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92260 - RNA, 1701 nt, Artificial Sequence
  derived and/or modified sequence opt2 from hemagglutinin__InfluenzaA__ABD60955
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccaagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccaccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacggccgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcggcaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92261 - RNA, 1701 nt, Artificial Sequence; identical to SEQ ID NO: 91544
  derived and/or modified sequence opt2 from hemagglutinin__InfluenzaA__ABD61260

SEQ ID NO: 92262 - RNA, 1701 nt, Artificial Sequence; identical to SEQ ID NO: 91544
  derived and/or modified sequence opt2 from hemagglutinin__InfluenzaA__ABD61271

SEQ ID NO: 92263 - RNA, 1701 nt, Artificial Sequence; identical to SEQ ID NO: 91798
  derived and/or modified sequence opt2 from hemagglutinin__InfluenzaA__ABD61282

SEQ ID NO: 92264 - RNA, 1701 nt, Artificial Sequence; identical to SEQ ID NO: 92028
  derived and/or modified sequence opt2 from hemagglutinin__InfluenzaA__ABD61293

SEQ ID NO: 92265 - RNA, 1701 nt, Artificial Sequence; identical to SEQ ID NO: 92250
  derived and/or modified sequence opt2 from hemagglutinin__InfluenzaA__ABD61304

SEQ ID NO: 92266 - RNA, 1701 nt, Artificial Sequence; identical to SEQ ID NO: 92162
  derived and/or modified sequence opt2 from hemagglutinin__InfluenzaA__ABD61315

SEQ ID NO: 92267 - RNA, 1701 nt, Artificial Sequence; identical to SEQ ID NO: 91584
  derived and/or modified sequence opt2 from hemagglutinin__InfluenzaA__ABD61337

SEQ ID NO: 92268 - RNA, 1701 nt, Artificial Sequence
  derived and/or modified sequence opt2 from hemagglutinin__InfluenzaA__ABD61348
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacaacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92269 - RNA, 1701 nt, Artificial Sequence; identical to SEQ ID NO: 91584
  derived and/or modified sequence opt2 from hemagglutinin__InfluenzaA__ABD61359

SEQ ID NO: 92270 - RNA, 1701 nt, Artificial Sequence; identical to SEQ ID NO: 92222
  derived and/or modified sequence opt2 from hemagglutinin__InfluenzaA__ABD61370

SEQ ID NO: 92271 - RNA, 1701 nt, Artificial Sequence; identical to SEQ ID NO: 92162
  derived and/or modified sequence opt2 from hemagglutinin__InfluenzaA__ABD61381

SEQ ID NO: 92272 - RNA, 1701 nt, Artificial Sequence
  derived and/or modified sequence opt2 from hemagglutinin__InfluenzaA__ABD61392
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgcggcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92273 - RNA, 1701 nt, Artificial Sequence; identical to SEQ ID NO: 92252
  derived and/or modified sequence opt2 from hemagglutinin__InfluenzaA__ABD61403

SEQ ID NO: 92274 - RNA, 1701 nt, Artificial Sequence
  derived and/or modified sequence opt2 from hemagglutinin__InfluenzaA__ABD61529
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccguccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggccgccucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92275 - RNA, 1698 nt, Artificial Sequence; identical to SEQ ID NO: 92253
  derived and/or modified sequence opt2 from hemagglutinin__InfluenzaA__ABD61540

SEQ ID NO: 92276 - RNA, 1701 nt, Artificial Sequence
  derived and/or modified sequence opt2 from hemagglutinin__InfluenzaA__ABD61757
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92277 - RNA, 1701 nt, Artificial Sequence
  derived and/or modified sequence opt2 from hemagglutinin__InfluenzaA__ABD61777
augaagaccaucaucgcccucuccuacaucuucugccucggcuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92278 - RNA, 1701 nt, Artificial Sequence
  derived and/or modified sequence opt2 from hemagglutinin__InfluenzaA__ABD77598
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccucccccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92279 - RNA, 1701 nt, Artificial Sequence; identical to SEQ ID NO: 92162
  derived and/or modified sequence opt2 from hemagglutinin__InfluenzaA__ABD77609

SEQ ID NO: 92280 - RNA, 1701 nt, Artificial Sequence; identical to SEQ ID NO: 92162
  derived and/or modified sequence opt2 from hemagglutinin__InfluenzaA__ABD77620

SEQ ID NO: 92281 - RNA, 1701 nt, Artificial Sequence; identical to SEQ ID NO: 92162
  derived and/or modified sequence opt2 from hemagglutinin__InfluenzaA__ABD77631

SEQ ID NO: 92282 - RNA, 1701 nt, Artificial Sequence; identical to SEQ ID NO: 92162
  derived and/or modified sequence opt2 from hemagglutinin__InfluenzaA__ABD77642

SEQ ID NO: 92283 - RNA, 1701 nt, Artificial Sequence; identical to SEQ ID NO: 92162
  derived and/or modified sequence opt2 from hemagglutinin__InfluenzaA__ABD77653

SEQ ID NO: 92284 - RNA, 1698 nt, Artificial Sequence; identical to SEQ ID NO: 92253
  derived and/or modified sequence opt2 from hemagglutinin__InfluenzaA__ABD77708

SEQ ID NO: 92285 - RNA, 1698 nt, Artificial Sequence
  derived and/or modified sequence opt2 from hemagglutinin__InfluenzaA__ABD77719
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92286 - RNA, 1698 nt, Artificial Sequence; identical to SEQ ID NO: 92253
  derived and/or modified sequence opt2 from hemagglutinin__InfluenzaA__ABD77730

SEQ ID NO: 92287 - RNA, 1701 nt, Artificial Sequence; identical to SEQ ID NO: 92162
  derived and/or modified sequence opt2 from hemagglutinin__InfluenzaA__ABD77752

SEQ ID NO: 92288 - RNA, 1701 nt, Artificial Sequence; identical to SEQ ID NO: 92162
  derived and/or modified sequence opt2 from hemagglutinin__InfluenzaA__ABD77763

SEQ ID NO: 92289 - RNA, 1701 nt, Artificial Sequence
  derived and/or modified sequence opt2 from hemagglutinin__InfluenzaA__ABD77774
augaagaccaucaucgcccucuccuacauccucugccucgucuucgcccagaagcuccccgucaacgacaacuccaccgccacccucugccucggccaccacgccguccccaacggcacccucgucaagaccaucaccaacgacaacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccagaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92290 - RNA, 1701 nt, Artificial Sequence; identical to SEQ ID NO: 92289
  derived and/or modified sequence opt2 from hemagglutinin__InfluenzaA__ABD77785

SEQ ID NO: 92291 - RNA, 1701 nt, Artificial Sequence
  derived and/or modified sequence opt2 from hemagglutinin__InfluenzaA__ABD77807
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccggcaaguccuccuucuacaagaaccuccucuggcucaccgagaccaacggcuccuaccccaagcucuccaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacgucaaguccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92292 - RNA, 1701 nt, Artificial Sequence
  derived and/or modified sequence opt2 from hemagglutinin__InfluenzaA__ABD77818
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaccgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaaguccaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92293 - RNA, 1701 nt, Artificial Sequence
  derived and/or modified sequence opt2 from hemagglutinin__InfluenzaA__ABD77829
augaagaccaucaucgcccucuccuacauccucuaccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgccucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92294 - RNA, 1701 nt, Artificial Sequence
  derived and/or modified sequence opt2 from hemagglutinin__InfluenzaA__ABD77862
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccuccaucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92295 - RNA, 1701 nt, Artificial Sequence
  derived and/or modified sequence opt2 from hemagglutinin__InfluenzaA__ABD77884
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagggcuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92296 - RNA, 1701 nt, Artificial Sequence
  derived and/or modified sequence opt2 from hemagglutinin__InfluenzaA__ABD77895
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucuccggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92297 - RNA, 1701 nt, Artificial Sequence; identical to SEQ ID NO: 92295
  derived and/or modified sequence opt2 from hemagglutinin__InfluenzaA__ABD77906

SEQ ID NO: 92298 - RNA, 1698 nt, Artificial Sequence
  derived and/or modified sequence opt2 from hemagglutinin__InfluenzaA__ABD77917
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92299 - RNA, 1698 nt, Artificial Sequence
  derived and/or modified sequence opt2 from hemagglutinin__InfluenzaA__ABD77928
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaagaagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92300 - RNA, 1698 nt, Artificial Sequence; identical to SEQ ID NO: 92254
  derived and/or modified sequence opt2 from hemagglutinin__InfluenzaA__ABD77939

SEQ ID NO: 92301 - RNA, 1698 nt, Artificial Sequence; identical to SEQ ID NO: 92254
  derived and/or modified sequence opt2 from hemagglutinin__InfluenzaA__ABD77950

SEQ ID NO: 92302 - RNA, 1698 nt, Artificial Sequence; identical to SEQ ID NO: 92253
  derived and/or modified sequence opt2 from hemagglutinin__InfluenzaA__ABD77961

SEQ ID NO: 92303 - RNA, 1698 nt, Artificial Sequence; identical to SEQ ID NO: 92254
  derived and/or modified sequence opt2 from hemagglutinin__InfluenzaA__ABD77983

SEQ ID NO: 92304 - RNA, 1698 nt, Artificial Sequence; identical to SEQ ID NO: 92254
  derived and/or modified sequence opt2 from hemagglutinin__InfluenzaA__ABD77994

SEQ ID NO: 92305 - RNA, 1698 nt, Artificial Sequence; identical to SEQ ID NO: 92253
  derived and/or modified sequence opt2 from hemagglutinin__InfluenzaA__ABD78005

SEQ ID NO: 92306 - RNA, 1698 nt, Artificial Sequence; identical to SEQ ID NO: 92253
  derived and/or modified sequence opt2 from hemagglutinin__InfluenzaA__ABD78016

SEQ ID NO: 92307 - RNA, 1698 nt, Artificial Sequence; identical to SEQ ID NO: 92254
  derived and/or modified sequence opt2 from hemagglutinin__InfluenzaA__ABD78027

SEQ ID NO: 92308 - RNA, 1698 nt, Artificial Sequence; identical to SEQ ID NO: 92254
  derived and/or modified sequence opt2 from hemagglutinin__InfluenzaA__ABD78038

SEQ ID NO: 92309 - RNA, 1701 nt, Artificial Sequence; identical to SEQ ID NO: 92289
  derived and/or modified sequence opt2 from hemagglutinin__InfluenzaA__ABD78049

SEQ ID NO: 92310 - RNA, 1698 nt, Artificial Sequence; identical to SEQ ID NO: 91808
  derived and/or modified sequence opt2 from hemagglutinin__InfluenzaA__ABD78060

SEQ ID NO: 92311 - RNA, 1698 nt, Artificial Sequence
  derived and/or modified sequence opt2 from hemagglutinin__InfluenzaA__ABD78071
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucuccggcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92312 - RNA, 1698 nt, Artificial Sequence
  derived and/or modified sequence opt2 from hemagglutinin__InfluenzaA__ABD78093
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92313 - RNA, 1701 nt, Artificial Sequence
  derived and/or modified sequence opt2 from hemagglutinin__InfluenzaA__ABD78115
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcaacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92314 - RNA, 1701 nt, Artificial Sequence
  derived and/or modified sequence opt2 from hemagglutinin__InfluenzaA__ABD78126
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92315 - RNA, 1701 nt, Artificial Sequence
  derived and/or modified sequence opt2 from hemagglutinin__InfluenzaA__ABD79032
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucuccgagggcuucaccuggaccggcgucacccagaacggcggcuccaacgccugcaagcgcggccccgacaucggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucuccgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92316 - RNA, 1701 nt, Artificial Sequence
  derived and/or modified sequence opt2 from hemagglutinin__InfluenzaA__ABD79112
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcgccugcuaccccggcgacuucgccgacuacgaggagcuccgcgagcagcucuccuccgucuccuccuucgagcgcuucgagaucuuccccaagggccgcuccuggcccgagcacaacaucgacaucggcgucaccgccgccugcucccacgccggcaaguccuccuucuacaagaaccuccucuggcucaccgagaaggacggcuccuaccccaaccucaacaaguccuacgucaacaagaaggagaaggagguccucauccucuggggcguccaccacccccccaacaucgagaaccagaagacccucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccugguacgccuucgcccucaaccgcggcaucggcuccggcaucaucaccuccaacgccuccauggacgagugcgacaccaagugccagaccccccagggcgccaucaacuccucccuccccuuccagaacauccaccccuucaccaucggcgagugccccaaguacguccgcuccaccaagcuccgcauggucaccggccuccgcaacauccccuccauccagucccgcggccucuucggcgccaucgccggcuucaucgagggcggcugggacggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguucuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92317 - RNA, 1701 nt, Artificial Sequence
  derived and/or modified sequence opt2 from hemagglutinin__InfluenzaA__ABD79123
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92318 - RNA, 1701 nt, Artificial Sequence
  derived and/or modified sequence opt2 from hemagglutinin__InfluenzaA__ABD79134
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaagaagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92319 - RNA, 1701 nt, Artificial Sequence
  derived and/or modified sequence opt2 from hemagglutinin__InfluenzaA__ABD79145
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92320 - RNA, 1701 nt, Artificial Sequence; identical to SEQ ID NO: 92319
  derived and/or modified sequence opt2 from hemagglutinin__InfluenzaA__ABD79156

SEQ ID NO: 92321 - RNA, 1701 nt, Artificial Sequence; identical to SEQ ID NO: 91535
  derived and/or modified sequence opt2 from hemagglutinin__InfluenzaA__ABD79167

SEQ ID NO: 92322 - RNA, 1701 nt, Artificial Sequence; identical to SEQ ID NO: 92319
  derived and/or modified sequence opt2 from hemagglutinin__InfluenzaA__ABD79178

SEQ ID NO: 92323 - RNA, 1701 nt, Artificial Sequence
  derived and/or modified sequence opt2 from hemagglutinin__InfluenzaA__ABD79189
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccgucgucaagcccggcgacauccuccucaucaacuccaccggcaaccucaucgccccccgcggcuacuucaagauccgcuccggcaaguccuccaucaugcgcuccgacgcccccaucgacuccugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92324 - RNA, 1701 nt, Artificial Sequence; identical to SEQ ID NO: 92319
  derived and/or modified sequence opt2 from hemagglutinin__InfluenzaA__ABD79200

SEQ ID NO: 92325 - RNA, 1701 nt, Artificial Sequence
  derived and/or modified sequence opt2 from hemagglutinin__InfluenzaA__ABD79211
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaccaaggagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggauccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92326 - RNA, 1701 nt, Artificial Sequence; identical to SEQ ID NO: 91535
  derived and/or modified sequence opt2 from hemagglutinin__InfluenzaA__ABD79222

SEQ ID NO: 92327 - RNA, 1701 nt, Artificial Sequence; identical to SEQ ID NO: 91535
  derived and/or modified sequence opt2 from hemagglutinin__InfluenzaA__ABD79233

SEQ ID NO: 92328 - RNA, 1701 nt, Artificial Sequence
  derived and/or modified sequence opt2 from hemagglutinin__InfluenzaA__ABD79244
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92329 - RNA, 1701 nt, Artificial Sequence; identical to SEQ ID NO: 91755
  derived and/or modified sequence opt2 from hemagglutinin__InfluenzaA__ABD94734

SEQ ID NO: 92330 - RNA, 1701 nt, Artificial Sequence; identical to SEQ ID NO: 92142
  derived and/or modified sequence opt2 from hemagglutinin__InfluenzaA__ABD94745

SEQ ID NO: 92331 - RNA, 1701 nt, Artificial Sequence
  derived and/or modified sequence opt2 from hemagglutinin__InfluenzaA__ABD94767
augaagaccaucaucgcccucuccuacauccucugccucgucuucgcccagaagcuccccgucaacgacaacuccaccgccacccucugccucggccaccacgccguccccaacggcacccucgucaagaccaucaccaacgacaacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaacgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92332 - RNA, 1698 nt, Artificial Sequence; identical to SEQ ID NO: 92312
  derived and/or modified sequence opt2 from hemagglutinin__InfluenzaA__ABD94778

SEQ ID NO: 92333 - RNA, 1698 nt, Artificial Sequence; identical to SEQ ID NO: 92312
  derived and/or modified sequence opt2 from hemagglutinin__InfluenzaA__ABD94789

SEQ ID NO: 92334 - RNA, 1701 nt, Artificial Sequence
  derived and/or modified sequence opt2 from hemagglutinin__InfluenzaA__ABD94822
augaagaccaucaucgcccucuccuacauccucugccucgucuucgcccagaagauccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgcuccuccaucaaguccuucuucucccgccucaacuggcuccaccagcucaaguacaaguaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92335 - RNA, 1701 nt, Artificial Sequence
  derived and/or modified sequence opt2 from hemagglutinin__InfluenzaA__ABD94833
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92336 - RNA, 1701 nt, Artificial Sequence
  derived and/or modified sequence opt2 from hemagglutinin__InfluenzaA__ABD94844
augaagaccaucaucgcccucuccuacauccucugcauggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92337 - RNA, 1701 nt, Artificial Sequence
  derived and/or modified sequence opt2 from hemagglutinin__InfluenzaA__ABD94855
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagggcuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92338 - RNA, 1701 nt, Artificial Sequence
  derived and/or modified sequence opt2 from hemagglutinin__InfluenzaA__ABD94866
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacggcccccaccagauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaguccuccggccgcaucaccgucuccaccaagcgcucccagcagaccgucacccccaacaucggcucccgccccuggguccgcggcgucuccucccgcaucuccaucuacuggaccaucgucaagcccggcgacauccuccucaucaccuccaccggcaaccucaucgccccccgcggcuacuucaagauccgccgcggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92339 - RNA, 1701 nt, Artificial Sequence
  derived and/or modified sequence opt2 from hemagglutinin__InfluenzaA__ABD94877
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92340 - RNA, 1701 nt, Artificial Sequence
  derived and/or modified sequence opt2 from hemagglutinin__InfluenzaA__ABD94888
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuucaagaacaaggagugggaccucuucgucgagcgcuccaccgccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92341 - RNA, 1701 nt, Artificial Sequence; identical to SEQ ID NO: 92319
  derived and/or modified sequence opt2 from hemagglutinin__InfluenzaA__ABD94899

SEQ ID NO: 92342 - RNA, 1701 nt, Artificial Sequence
  derived and/or modified sequence opt2 from hemagglutinin__InfluenzaA__ABD94910
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92343 - RNA, 1701 nt, Artificial Sequence
  derived and/or modified sequence opt2 from hemagglutinin__InfluenzaA__ABD94921
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacggcccccaccagauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaguccuccggccgcgucaccgucuccaccaagcgcucccagcagaccgucacccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgccgcggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92344 - RNA, 1701 nt, Artificial Sequence; identical to SEQ ID NO: 92319
  derived and/or modified sequence opt2 from hemagglutinin__InfluenzaA__ABD94932

SEQ ID NO: 92345 - RNA, 1698 nt, Artificial Sequence
  derived and/or modified sequence opt2 from hemagglutinin__InfluenzaA__ABD94943
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaagaagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92346 - RNA, 1701 nt, Artificial Sequence; identical to SEQ ID NO: 92145
  derived and/or modified sequence opt2 from hemagglutinin__InfluenzaA__ABD94954

SEQ ID NO: 92347 - RNA, 1698 nt, Artificial Sequence; identical to SEQ ID NO: 92254
  derived and/or modified sequence opt2 from hemagglutinin__InfluenzaA__ABD94965

SEQ ID NO: 92348 - RNA, 1698 nt, Artificial Sequence; identical to SEQ ID NO: 92253
  derived and/or modified sequence opt2 from hemagglutinin__InfluenzaA__ABD94987

SEQ ID NO: 92349 - RNA, 1698 nt, Artificial Sequence; identical to SEQ ID NO: 92253
  derived and/or modified sequence opt2 from hemagglutinin__InfluenzaA__ABD94998

SEQ ID NO: 92350 - RNA, 1698 nt, Artificial Sequence; identical to SEQ ID NO: 92253
  derived and/or modified sequence opt2 from hemagglutinin__InfluenzaA__ABD95009

SEQ ID NO: 92351 - RNA, 1698 nt, Artificial Sequence; identical to SEQ ID NO: 92254
  derived and/or modified sequence opt2 from hemagglutinin__InfluenzaA__ABD95020

SEQ ID NO: 92352 - RNA, 1698 nt, Artificial Sequence
  derived and/or modified sequence opt2 from hemagglutinin__InfluenzaA__ABD95031
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucaccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccuccgccgcuccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92353 - RNA, 1698 nt, Artificial Sequence
  derived and/or modified sequence opt2 from hemagglutinin__InfluenzaA__ABD95042
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaagggcaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92354 - RNA, 1698 nt, Artificial Sequence; identical to SEQ ID NO: 92353
  derived and/or modified sequence opt2 from hemagglutinin__InfluenzaA__ABD95053

SEQ ID NO: 92355 - RNA, 1698 nt, Artificial Sequence; identical to SEQ ID NO: 92312
  derived and/or modified sequence opt2 from hemagglutinin__InfluenzaA__ABD95064

SEQ ID NO: 92356 - RNA, 1698 nt, Artificial Sequence
  derived and/or modified sequence opt2 from hemagglutinin__InfluenzaA__ABD95075
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucuccaagggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92357 - RNA, 1698 nt, Artificial Sequence; identical to SEQ ID NO: 92353
  derived and/or modified sequence opt2 from hemagglutinin__InfluenzaA__ABD95086

SEQ ID NO: 92358 - RNA, 1698 nt, Artificial Sequence; identical to SEQ ID NO: 92312
  derived and/or modified sequence opt2 from hemagglutinin__InfluenzaA__ABD95097

SEQ ID NO: 92359 - RNA, 1698 nt, Artificial Sequence
  derived and/or modified sequence opt2 from hemagglutinin__InfluenzaA__ABD95119
augaaggccaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92360 - RNA, 1698 nt, Artificial Sequence
  derived and/or modified sequence opt2 from hemagglutinin__InfluenzaA__ABD95130
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggcuccuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92361 - RNA, 1698 nt, Artificial Sequence; identical to SEQ ID NO: 92312
  derived and/or modified sequence opt2 from hemagglutinin__InfluenzaA__ABD95141

SEQ ID NO: 92362 - RNA, 1698 nt, Artificial Sequence; identical to SEQ ID NO: 92312
  derived and/or modified sequence opt2 from hemagglutinin__InfluenzaA__ABD95152

SEQ ID NO: 92363 - RNA, 1698 nt, Artificial Sequence; identical to SEQ ID NO: 92359
  derived and/or modified sequence opt2 from hemagglutinin__InfluenzaA__ABD95163

SEQ ID NO: 92364 - RNA, 1698 nt, Artificial Sequence; identical to SEQ ID NO: 92353
  derived and/or modified sequence opt2 from hemagglutinin__InfluenzaA__ABD95174

SEQ ID NO: 92365 - RNA, 1698 nt, Artificial Sequence
  derived and/or modified sequence opt2 from hemagglutinin__InfluenzaA__ABD95185
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92366 - RNA, 1698 nt, Artificial Sequence; identical to SEQ ID NO: 92353
  derived and/or modified sequence opt2 from hemagglutinin__InfluenzaA__ABD95196

SEQ ID NO: 92367 - RNA, 1698 nt, Artificial Sequence; identical to SEQ ID NO: 91811
  derived and/or modified sequence opt2 from hemagglutinin__InfluenzaA__ABD95207

SEQ ID NO: 92368 - RNA, 1698 nt, Artificial Sequence; identical to SEQ ID NO: 92312
  derived and/or modified sequence opt2 from hemagglutinin__InfluenzaA__ABD95218

SEQ ID NO: 92369 - RNA, 1698 nt, Artificial Sequence; identical to SEQ ID NO: 92359
  derived and/or modified sequence opt2 from hemagglutinin__InfluenzaA__ABD95229

SEQ ID NO: 92370 - RNA, 1698 nt, Artificial Sequence; identical to SEQ ID NO: 92312
  derived and/or modified sequence opt2 from hemagglutinin__InfluenzaA__ABD95240

SEQ ID NO: 92371 - RNA, 1698 nt, Artificial Sequence; identical to SEQ ID NO: 92353
  derived and/or modified sequence opt2 from hemagglutinin__InfluenzaA__ABD95251

SEQ ID NO: 92372 - RNA, 1698 nt, Artificial Sequence; identical to SEQ ID NO: 91811
  derived and/or modified sequence opt2 from hemagglutinin__InfluenzaA__ABD95262

SEQ ID NO: 92373 - RNA, 1698 nt, Artificial Sequence; identical to SEQ ID NO: 92312
  derived and/or modified sequence opt2 from hemagglutinin__InfluenzaA__ABD95273

SEQ ID NO: 92374 - RNA, 1698 nt, Artificial Sequence; identical to SEQ ID NO: 91808
  derived and/or modified sequence opt2 from hemagglutinin__InfluenzaA__ABD95284

SEQ ID NO: 92375 - RNA, 1698 nt, Artificial Sequence; identical to SEQ ID NO: 92312
  derived and/or modified sequence opt2 from hemagglutinin__InfluenzaA__ABD95295

SEQ ID NO: 92376 - RNA, 1698 nt, Artificial Sequence
  derived and/or modified sequence opt2 from hemagglutinin__InfluenzaA__ABD95306
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagauccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92377 - RNA, 1698 nt, Artificial Sequence; identical to SEQ ID NO: 92353
  derived and/or modified sequence opt2 from hemagglutinin__InfluenzaA__ABD95328

SEQ ID NO: 92378 - RNA, 1701 nt, Artificial Sequence
  derived and/or modified sequence opt2 from hemagglutinin__InfluenzaA__ABD95339
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacuccgucacccgcggcgucaccgccuccugcucccacaagggcaaguccuccuucuaccgcaaccuccucuggcucaccgagaagaacggcuccuaccccaaccucuccaaguccuacgucaacgacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgucuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92379 - RNA, 1698 nt, Artificial Sequence; identical to SEQ ID NO: 92254
  derived and/or modified sequence opt2 from hemagglutinin__InfluenzaA__ABE11657

SEQ ID NO: 92380 - RNA, 1698 nt, Artificial Sequence
  derived and/or modified sequence opt2 from hemagglutinin__InfluenzaA__ABE11668
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92381 - RNA, 1698 nt, Artificial Sequence
  derived and/or modified sequence opt2 from hemagglutinin__InfluenzaA__ABE11679
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggccgcaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92382 - RNA, 1698 nt, Artificial Sequence
  derived and/or modified sequence opt2 from hemagglutinin__InfluenzaA__ABE11690
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92383 - RNA, 1698 nt, Artificial Sequence
  derived and/or modified sequence opt2 from hemagglutinin__InfluenzaA__ABE11701
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92384 - RNA, 1698 nt, Artificial Sequence; identical to SEQ ID NO: 92312
  derived and/or modified sequence opt2 from hemagglutinin__InfluenzaA__ABE11712

SEQ ID NO: 92385 - RNA, 1698 nt, Artificial Sequence; identical to SEQ ID NO: 92353
  derived and/or modified sequence opt2 from hemagglutinin__InfluenzaA__ABE11723

SEQ ID NO: 92386 - RNA, 1698 nt, Artificial Sequence; identical to SEQ ID NO: 92359
  derived and/or modified sequence opt2 from hemagglutinin__InfluenzaA__ABE11734

SEQ ID NO: 92387 - RNA, 1698 nt, Artificial Sequence; identical to SEQ ID NO: 92312
  derived and/or modified sequence opt2 from hemagglutinin__InfluenzaA__ABE11812

SEQ ID NO: 92388 - RNA, 1698 nt, Artificial Sequence; identical to SEQ ID NO: 92353
  derived and/or modified sequence opt2 from hemagglutinin__InfluenzaA__ABE11823

SEQ ID NO: 92389 - RNA, 1698 nt, Artificial Sequence; identical to SEQ ID NO: 92353
  derived and/or modified sequence opt2 from hemagglutinin__InfluenzaA__ABE11834

SEQ ID NO: 92390 - RNA, 1698 nt, Artificial Sequence; identical to SEQ ID NO: 92353
  derived and/or modified sequence opt2 from hemagglutinin__InfluenzaA__ABE11845

SEQ ID NO: 92391 - RNA, 1698 nt, Artificial Sequence; identical to SEQ ID NO: 92359
  derived and/or modified sequence opt2 from hemagglutinin__InfluenzaA__ABE11856

SEQ ID NO: 92392 - RNA, 1701 nt, Artificial Sequence
  derived and/or modified sequence opt2 from hemagglutinin__InfluenzaA__ABE11900
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucaucucccucggcgccaucuccuucuggaugugcuccaacggcucccuccagugccgcaucugcaucuga

SEQ ID NO: 92393 - RNA, 1701 nt, Artificial Sequence
  derived and/or modified sequence opt2 from hemagglutinin__InfluenzaA__ABE11942
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccucccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92394 - RNA, 1701 nt, Artificial Sequence
  derived and/or modified sequence opt2 from hemagglutinin__InfluenzaA__ABE12078
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 92395 - RNA, 1701 nt, Artificial Sequence; identical to SEQ ID NO: 92289
  derived and/or modified sequence opt2 from hemagglutinin__InfluenzaA__ABE12123

SEQ ID NO: 92396 - RNA, 1698 nt, Artificial Sequence; identical to SEQ ID NO: 92312
  derived and/or modified sequence opt2 from hemagglutinin__InfluenzaA__ABE12248

SEQ ID NO: 92397 - RNA, 1701 nt, Artificial Sequence
  derived and/or modified sequence opt2 from hemagglutinin__InfluenzaA__ABE12623
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92398 - RNA, 1701 nt, Artificial Sequence; identical to SEQ ID NO: 92342
  derived and/or modified sequence opt2 from hemagglutinin__InfluenzaA__ABE12645

SEQ ID NO: 92399 - RNA, 1701 nt, Artificial Sequence; identical to SEQ ID NO: 92319
  derived and/or modified sequence opt2 from hemagglutinin__InfluenzaA__ABE13076

SEQ ID NO: 92400 - RNA, 1701 nt, Artificial Sequence; identical to SEQ ID NO: 92295
  derived and/or modified sequence opt2 from hemagglutinin__InfluenzaA__ABE13323

SEQ ID NO: 92401 - RNA, 1701 nt, Artificial Sequence
  derived and/or modified sequence opt2 from hemagglutinin__InfluenzaA__ABE13471
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucuacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92402 - RNA, 1701 nt, Artificial Sequence
  derived and/or modified sequence opt2 from hemagglutinin__InfluenzaA__ABE13555
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagggcuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagaccaagggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucguccuccucggcuucaucaugugggccugccagaagggcaacauccgcugcaacaucugcaucuga

SEQ ID NO: 92403 - RNA, 1701 nt, Artificial Sequence
  derived and/or modified sequence opt2 from hemagglutinin__InfluenzaA__ABE13606
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagaugguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucaucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92404 - RNA, 1701 nt, Artificial Sequence
  derived and/or modified sequence opt2 from hemagglutinin__InfluenzaA__ABE13628
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92405 - RNA, 1701 nt, Artificial Sequence
  derived and/or modified sequence opt2 from hemagglutinin__InfluenzaA__ABE13824
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92406 - RNA, 1701 nt, Artificial Sequence; identical to SEQ ID NO: 92405
  derived and/or modified sequence opt2 from hemagglutinin__InfluenzaA__ABE14019

SEQ ID NO: 92407 - RNA, 1701 nt, Artificial Sequence
  derived and/or modified sequence opt2 from hemagglutinin__InfluenzaA__ABE14030
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaucggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92408 - RNA, 1701 nt, Artificial Sequence; identical to SEQ ID NO: 92404
  derived and/or modified sequence opt2 from hemagglutinin__InfluenzaA__ABE14041

SEQ ID NO: 92409 - RNA, 1701 nt, Artificial Sequence; identical to SEQ ID NO: 92405
  derived and/or modified sequence opt2 from hemagglutinin__InfluenzaA__ABE14063

SEQ ID NO: 92410 - RNA, 1701 nt, Artificial Sequence
  derived and/or modified sequence opt2 from hemagglutinin__InfluenzaA__ABE14124
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucaucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92411 - RNA, 1701 nt, Artificial Sequence
  derived and/or modified sequence opt2 from hemagglutinin__InfluenzaA__ABE14464
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92412 - RNA, 1701 nt, Artificial Sequence
  derived and/or modified sequence opt2 from hemagglutinin__InfluenzaA__ABE14840
augaagaccaucaucgcccucuccuacauccucugccucgucuucgcccagaagcucccccgcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 92413 - RNA, 1701 nt, Artificial Sequence
  derived and/or modified sequence opt2 from hemagglutinin__InfluenzaA__ABE15578
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 92414 - RNA, 1701 nt, Artificial Sequence
  derived and/or modified sequence opt2 from hemagglutinin__InfluenzaA__ABE26991
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgacugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccacccucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92415 - RNA, 1701 nt, Artificial Sequence
  derived and/or modified sequence opt2 from hemagglutinin__InfluenzaA__ABF47550
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92416 - RNA, 1698 nt, Artificial Sequence
  derived and/or modified sequence opt2 from hemagglutinin__InfluenzaA__ABF47561
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaagcucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92417 - RNA, 1698 nt, Artificial Sequence
  derived and/or modified sequence opt2 from hemagglutinin__InfluenzaA__ABF47572
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggacaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92418 - RNA, 1698 nt, Artificial Sequence; identical to SEQ ID NO: 92312
  derived and/or modified sequence opt2 from hemagglutinin__InfluenzaA__ABF47583

SEQ ID NO: 92419 - RNA, 1701 nt, Artificial Sequence
  derived and/or modified sequence opt2 from hemagglutinin__InfluenzaA__ABF47594
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccagaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92420 - RNA, 1701 nt, Artificial Sequence
  derived and/or modified sequence opt2 from hemagglutinin__InfluenzaA__ABF47605
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccuccggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcaucgagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92421 - RNA, 1701 nt, Artificial Sequence; identical to SEQ ID NO: 92405
  derived and/or modified sequence opt2 from hemagglutinin__InfluenzaA__ABF47616

SEQ ID NO: 92422 - RNA, 1701 nt, Artificial Sequence
  derived and/or modified sequence opt2 from hemagglutinin__InfluenzaA__ABF47627
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgacugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92423 - RNA, 1701 nt, Artificial Sequence
  derived and/or modified sequence opt2 from hemagglutinin__InfluenzaA__ABF47638
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92424 - RNA, 1701 nt, Artificial Sequence; identical to SEQ ID NO: 92423
  derived and/or modified sequence opt2 from hemagglutinin__InfluenzaA__ABF47649

SEQ ID NO: 92425 - RNA, 1701 nt, Artificial Sequence
  derived and/or modified sequence opt2 from hemagglutinin__InfluenzaA__ABF47660
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcauccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgacugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92426 - RNA, 1698 nt, Artificial Sequence
  derived and/or modified sequence opt2 from hemagglutinin__InfluenzaA__ABF47671
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuucgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92427 - RNA, 1701 nt, Artificial Sequence
  derived and/or modified sequence opt2 from hemagglutinin__InfluenzaA__ABF47693
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucaaccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92428 - RNA, 1701 nt, Artificial Sequence; identical to SEQ ID NO: 92427
  derived and/or modified sequence opt2 from hemagglutinin__InfluenzaA__ABF47704

SEQ ID NO: 92429 - RNA, 1701 nt, Artificial Sequence
  derived and/or modified sequence opt2 from hemagglutinin__InfluenzaA__ABF47715
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucaaccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92430 - RNA, 1701 nt, Artificial Sequence; identical to SEQ ID NO: 92427
  derived and/or modified sequence opt2 from hemagglutinin__InfluenzaA__ABF47726

SEQ ID NO: 92431 - RNA, 1701 nt, Artificial Sequence; identical to SEQ ID NO: 92427
  derived and/or modified sequence opt2 from hemagglutinin__InfluenzaA__ABF47737

SEQ ID NO: 92432 - RNA, 1701 nt, Artificial Sequence
  derived and/or modified sequence opt2 from hemagglutinin__InfluenzaA__ABF47748
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92433 - RNA, 1701 nt, Artificial Sequence
  derived and/or modified sequence opt2 from hemagglutinin__InfluenzaA__ABF47770
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92434 - RNA, 1701 nt, Artificial Sequence; identical to SEQ ID NO: 92433
  derived and/or modified sequence opt2 from hemagglutinin__InfluenzaA__ABF47781

SEQ ID NO: 92435 - RNA, 1701 nt, Artificial Sequence; identical to SEQ ID NO: 92433
  derived and/or modified sequence opt2 from hemagglutinin__InfluenzaA__ABF47792

SEQ ID NO: 92436 - RNA, 1701 nt, Artificial Sequence; identical to SEQ ID NO: 92433
  derived and/or modified sequence opt2 from hemagglutinin__InfluenzaA__ABF47803

SEQ ID NO: 92437 - RNA, 1701 nt, Artificial Sequence; identical to SEQ ID NO: 92433
  derived and/or modified sequence opt2 from hemagglutinin__InfluenzaA__ABF47814

SEQ ID NO: 92438 - RNA, 1701 nt, Artificial Sequence; identical to SEQ ID NO: 92433
  derived and/or modified sequence opt2 from hemagglutinin__InfluenzaA__ABF47825

SEQ ID NO: 92439 - RNA, 1701 nt, Artificial Sequence; identical to SEQ ID NO: 92433
  derived and/or modified sequence opt2 from hemagglutinin__InfluenzaA__ABF47836

SEQ ID NO: 92440 - RNA, 1701 nt, Artificial Sequence; identical to SEQ ID NO: 92433
  derived and/or modified sequence opt2 from hemagglutinin__InfluenzaA__ABF47847

SEQ ID NO: 92441 - RNA, 1701 nt, Artificial Sequence
  derived and/or modified sequence opt2 from hemagglutinin__InfluenzaA__ABF47858
augaagaccaucaucgcccucuccuacauccucugccucgucuucgcccagaagcuccccggcaacgacaacggcaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92442 - RNA, 1698 nt, Artificial Sequence; identical to SEQ ID NO: 92254
  derived and/or modified sequence opt2 from hemagglutinin__InfluenzaA__ABF47869

SEQ ID NO: 92443 - RNA, 1698 nt, Artificial Sequence; identical to SEQ ID NO: 92254
  derived and/or modified sequence opt2 from hemagglutinin__InfluenzaA__ABF47880

SEQ ID NO: 92444 - RNA, 1698 nt, Artificial Sequence
  derived and/or modified sequence opt2 from hemagglutinin__InfluenzaA__ABF47891
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucacccgcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92445 - RNA, 1701 nt, Artificial Sequence
  derived and/or modified sequence opt2 from hemagglutinin__InfluenzaA__ABF47902
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaaguccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92446 - RNA, 1698 nt, Artificial Sequence
  derived and/or modified sequence opt2 from hemagglutinin__InfluenzaA__ABF47955
augaaggccaagcuccucguccuccucuacgccuucgucgccaccgacgccgacaccaucugcaucggcuaccacgccaacaacuccaccgacaccgucgacaccaucuucgagaagaacgucgccgucacccacuccgucaaccuccucgaggaccgccacaacggcaagcucugcaagcucaagggcaucgccccccuccagcucggcaagugcaacaucaccggcuggcuccucggcaaccccgagugcgacucccuccuccccgcccgcuccugguccuacaucgucgagacccccaacuccgagaacggcgccugcuaccccggcgacuucaucgacuacgaggagcuccgcgagcagcucuccuccgucuccucccucgagcgcuucgagaucuuccccaaggaguccuccuggcccaaccacaccuucaacggcgucaccgucuccugcucccaccgcggcaaguccuccuucuaccgcaaccuccucuggcucaccaagaagggcgacuccuaccccaagcucaccaacuccuacgucaacaacaagggcaaggagguccucguccucuggggcguccaccaccccuccuccuccgacgagcagcagucccucuacuccaacggcaacgccuacgucuccgucgccuccuccaacuacaaccgccgcuucacccccgagaucgccgcccgccccaaggucaaggaccagcacggccgcaugaacuacuacuggacccuccucgagcccggcgacaccaucaucuucgaggccaccggcaaccucaucgcccccugguacgccuucgcccucucccgcggcuucgaguccggcaucaucaccuccaacgccuccaugcacgagugcaacaccaagugccagaccccccagggcuccaucaacuccaaccuccccuuccagaacauccaccccgucaccaucggcgagugccccaaguacguccgcuccaccaagcuccgcauggucaccggccuccgcaacauccccuccauccaguaccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaaccgcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92447 - RNA, 1698 nt, Artificial Sequence
  derived and/or modified sequence opt2 from hemagglutinin__InfluenzaA__ABF60576
augaagaccaccaucauccucauccuccucacccacgccgucgacucccagaaccccaucuccggcaacaacaccgccacccucugccucggccaccacgccgucgccaacggcacccucgucaagaccaucaccgacgaccagaucgaggucaccaacgccaccgagcucguccaguccaccuccaucggcaagaucugcaacaaccccuaccgcguccucgacggccgcaacugcacccucaucgacgccaugcucggcgacccccacugcgacgucuuccaguacgagaacugggaccucuucaucgagcgcuccuccgccuucuccaacugcuaccccuacgacauccccgacuacgccucccuccgcuccaucgucgccuccuccggcacccucgaguucaccgccgagggcuucaccuggaccggcgucacccagaacggcggcuccggcgccugccgccgcggcuccgccgacuccuucuucucccgccucaacuggcucaccaaguccggcaacuccuaccccacccucaacgucaccaugcccaacaacgacaacuucgacaagcucuacaucuggggcauccaccaccccuccaccaacaacgagcagaccaagcucuacguccaggagcucggccgcgucaccgucuccaccaagcgcucccagcagaccaucauccccaacaucggcucccgccccggcguccgcggccaggccggccgcaucuccaucuacuggaccaucgucaagcccggcgacauccucaugaucaacuccaacggcaaccucgucgccccccgcggcuacuucaagaugcgcaccggcaaguccuccaucaugcgcuccgacgcccccaucgacaccugcugguccgagugcaucacccccaacggcuccauccccaacgacaagcccuuccagaacgucaacaaggucaccuacggcaagugccccaaguacaucaagcagaacacccucaagcucgccaccggcaugcgcaacguccccgagaagcagauccgcggcaucuucggcgccaucgccggcuucaucgagaacggcugggagggcauggucgacggcugguacggcuuccgcuaccagaacuccgagggcaccggccaggccgccgaccucaaguccacccaggccgccaucgaccagaucaacggcaagcucaaccgcgucaucgagcgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacgccgagaugaacaagcucuucgagaagacccgccgccagcuccgcgagaacgccgaggacaugggcggcggcugcuucaagaucuaccacaagugcgacaacgccugcaucggcuccauccgcaacggcaccuacgaccacuacaucuaccgcgacgaggcccucaacaaccgcuuccagaucaagggcgucgagcucaaguccggcuacaaggacuggauccucuggaucuccuucgccaucuccugcuuccucaucugcgucguccuccucggcuucaucaugugggccugcgagaagggcaacauccgcugcaacaucugcaucuga

SEQ ID NO: 92448 - RNA, 1701 nt, Artificial Sequence
  derived and/or modified sequence opt2 from hemagglutinin__InfluenzaA__ABF60577
augaagaccaucaucguccucuccuacuucuucugccucgcccucucccaggacuacuccgaguccaacaacuccaccgccacccucugccucggccaccacgccguccccaacggcaccaucgucaagaccaucaccgacgaccagaucgaggucaccaacgccaccgagcucguccaguccuccuccaccggcaagaucugcaacaacccccaccgcauccucgacggccgcgacugcacccucaucgacgcccuccucggcgacccccacugcgacgucuuccaggacgagaccugggaccucuacgucgagcgcuccuccgccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccgccuccggcuucuucucccgccucaacuggcucaccaaguccggcuccaccuaccccguccucaacgucaccaugcccaacgacgacaacuucgacaagcucuacgucuggggcguccaccaccccuccaccaaccaggagcagaccgaccucuacguccaggccuccggccgcgucaccgucuccacccgccgcucccagcagaccaucauccccaacaucggcucccgccccuggguccgcggccaguccggccgcaucuccaucuacuggaccaucgucaagcccggcgacguccucgucaucaacuccaacggcaaccucaucgccccccgcggcuacuucaagauccgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcaguccacccucaagcucgccaccggcaugcgcaacguccccgagaagaagacccgcggccucuucgucgccaucgccggcuucaucgagaacggcugggagggcaugaucgacugcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaacuacgucgaggacaccaagaucgaccucugguccuacaacgccgagcuccucgucgcccucgagaaccagcacaccaucgaccucaccgacuccgagaugaacaagcucuucgagcgcacccgccgccagcuccgcgagaacgccgaggacaugggcuccggcugcuucaagaucuaccacaagugcgacaacgccugcaucgaguccauccgcaacggcaccuacgaccacgacaucuaccgcgacgaggcccucaacaaccgcuuccagaucaagggcgucgagcucaaguccggcuacaaggacuggauccucuggaucuccuucgccaccuccugcuuccuccucugcgucguccucggcggcuucaucaugugggccugccagcgcggcaacauccgcugcaacaucugcaucuga

SEQ ID NO: 92449 - RNA, 1701 nt, Artificial Sequence
  derived and/or modified sequence opt2 from hemagglutinin__InfluenzaA__ABF60578
augaagaccaucaucguccucuccugcuucuucugccucgccuucucccaggaccucuccgagaacaacaacaacaccgccacccucugccucggccaccacgccguccccaacggcaccaucgucaagaccaucaccgacgaccagaucgaggucaccaacgccaccgagcucguccaguccuccuccaccggcaagaucugcaacaacccccaccgcauccucgacggccgcgacugcacccucaucgacgcccuccucggcgacccccacugcgacgucuuccaggacgagaccugggaccucuacgucgagcgcuccaaguccuucuccaacugcuaccccuacgacguccccgacuacgccucccuccgcucccucgucgccuccuccggcacccucgaguucaucaccgaggccuucaccuggaccggcgucacccagaacggcggcuccggcgccugcaagcgcggccccggcaacggcuucuucucccgccucaacuggcucaccaaguccggcuccgccuaccccguccucaacgucaccaugcccaacaacgacaacuucgacaagcucuacgucuggggcguccaccaccccuccaccaaccaggagcagaccaaccucuacguccaggccuccggccgcgucaccgucuccacccgccgcucccagcagaccaucauccccaacaucggcucccgccccuggguccgcggccagucccgccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacaucaagcaguccacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgacguccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacaucuaccgcgacgaggcccucaacaaccgcuuccagaucaagggcugcggcgucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 92450 - RNA, 1701 nt, Artificial Sequence
  derived and/or modified sequence opt2 from hemagglutinin__InfluenzaA__ABF60579
augaagacccucaucgcccucuccuacaucuucugccucguccucggccaggaccuccccggcaacggcaacuccaccgccacccucugccucggccaccacgccguccccaacggcacccucgucaagaccaucaccgacgaccagaucgaggucaccaacgccaccgagcucguccagaacuucuccauggacaagaucugcaacaacccccaccgcauccucgacggcgccaacugcacccucaucgacgcccuccucggcgacccccacugcgacgacuuccagaacgagaagugggaccucuucgucgagcgcuccaaggccuucuccaacugcuaccccuacgacguccccgacuacaccucccuccgcucccucaucgccuccuccggcacccucgaguucaucaacgaggacuucaacuggaccggcgucacccagaacggcggcuccaacgccugcaagcgcggccccgacuccuccuucuucucccgccucaacuggcucuacaaguccggcaacaccuaccccaugcucaacgucaccaugcccaacuccgacaacuucgacaagcucuacaucuggggcguccaccaccccuccaccgcccgcgagcagaccaaccucuacguccaggccuccggcaaggucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcacaccggccgcuccuccaucaugcgcuccgacgcccccaucgacaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccggcgucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacaacgaguaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92451 - RNA, 1701 nt, Artificial Sequence
  derived and/or modified sequence opt2 from hemagglutinin__InfluenzaA__ABF60580
augaagaccaucaucgcccucuccuacaucuucugccucgccuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcauccagcagaccgucauccccaacgucggcucccgccccuggguccgcggccucuccucccgcgucuccaucuacuggaccaucgucaagcccggcgacguccucgucaucaacuccaacggcaaccucaucgccccccgcggcuacuacaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagguccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92452 - RNA, 1701 nt, Artificial Sequence
  derived and/or modified sequence opt2 from hemagglutinin__InfluenzaA__ABF60581
augaagaccaucaucguccucuccuacuucuucugccucgcccucucccaggacuacuccgaguccaacaacuccaccgccacccucugccucggccaccacgccguccccaacggcaccaucgucaagaccaucaccgacgaccagaucgaggucaccaacgccaccgagcucguccaguccuccuccaccggcaagaucugcaacaacccccaccgcauccucgacggccgcgacugcacccucaucgacgcccuccucggcgacccccacugcgacgucuuccaggacgagaccugggaccucuacgucgagcgcuccuccgccuucuccaacugcuaccccuacgacguccccgacuacgacucccuccgcucccucgucgccuccuccggcacccucgaguucaucaccgagggcuucaccuggaccggcgucacccagaacggcggcuccaacgccugcaagcgcggccccgccuccggcuucuucucccgccucaacuggcucaccaaguccggcuccaccuaccccguccucaacgucaccaugcccaacaacgacaacuucgacaagcucuacgucuggggcguccaccaccccuccaccaaccaggagcagaccaaccucuacguccaggccuccggccgcgucaccgucuccacccgccgcucccagcagaccaucauccccaacaucggcucccgccccuggguccgcggccaguccggccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaugcccuuccagaacgucaacaagaucaccuacggcgccugccccaaguacgucaagcagggcacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccgacaacgccgagcuccucgucgcccucgagaaccagcacaccaucgaccucaccgacuccgagaugaacaagcucuucgagaagacccgccgccagcuccgcgagaacgccgaggucaugggcaacggcugcuucaagaucuaccacaagugcgacaacgccugcaucgaguccauccgcaacggcaccuacgaccacgacaucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 92453 - RNA, 1701 nt, Artificial Sequence; identical to SEQ ID NO: 92252
  derived and/or modified sequence opt2 from hemagglutinin__InfluenzaA__ABF82651

SEQ ID NO: 92454 - RNA, 1698 nt, Artificial Sequence; identical to SEQ ID NO: 92312
  derived and/or modified sequence opt2 from hemagglutinin__InfluenzaA__ABF82662

SEQ ID NO: 92455 - RNA, 1698 nt, Artificial Sequence
  derived and/or modified sequence opt2 from hemagglutinin__InfluenzaA__ABF82673
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagggcuccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92456 - RNA, 1698 nt, Artificial Sequence; identical to SEQ ID NO: 92353
  derived and/or modified sequence opt2 from hemagglutinin__InfluenzaA__ABF82684

SEQ ID NO: 92457 - RNA, 1701 nt, Artificial Sequence; identical to SEQ ID NO: 92319
  derived and/or modified sequence opt2 from hemagglutinin__InfluenzaA__ABF82695

SEQ ID NO: 92458 - RNA, 1701 nt, Artificial Sequence; identical to SEQ ID NO: 92295
  derived and/or modified sequence opt2 from hemagglutinin__InfluenzaA__ABF82706

SEQ ID NO: 92459 - RNA, 1698 nt, Artificial Sequence; identical to SEQ ID NO: 91811
  derived and/or modified sequence opt2 from hemagglutinin__InfluenzaA__ABF82819

SEQ ID NO: 92460 - RNA, 1698 nt, Artificial Sequence; identical to SEQ ID NO: 92312
  derived and/or modified sequence opt2 from hemagglutinin__InfluenzaA__ABF82830

SEQ ID NO: 92461 - RNA, 1698 nt, Artificial Sequence; identical to SEQ ID NO: 92312
  derived and/or modified sequence opt2 from hemagglutinin__InfluenzaA__ABF82841

SEQ ID NO: 92462 - RNA, 1698 nt, Artificial Sequence; identical to SEQ ID NO: 92312
  derived and/or modified sequence opt2 from hemagglutinin__InfluenzaA__ABF82852

SEQ ID NO: 92463 - RNA, 1698 nt, Artificial Sequence
  derived and/or modified sequence opt2 from hemagglutinin__InfluenzaA__ABF82863
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguucuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92464 - RNA, 1698 nt, Artificial Sequence
  derived and/or modified sequence opt2 from hemagglutinin__InfluenzaA__ABF82874
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaucaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92465 - RNA, 1698 nt, Artificial Sequence; identical to SEQ ID NO: 92312
  derived and/or modified sequence opt2 from hemagglutinin__InfluenzaA__ABF82885

SEQ ID NO: 92466 - RNA, 1698 nt, Artificial Sequence; identical to SEQ ID NO: 92312
  derived and/or modified sequence opt2 from hemagglutinin__InfluenzaA__ABF82896

SEQ ID NO: 92467 - RNA, 1698 nt, Artificial Sequence; identical to SEQ ID NO: 92312
  derived and/or modified sequence opt2 from hemagglutinin__InfluenzaA__ABF82907

SEQ ID NO: 92468 - RNA, 1698 nt, Artificial Sequence; identical to SEQ ID NO: 92356
  derived and/or modified sequence opt2 from hemagglutinin__InfluenzaA__ABF82929

SEQ ID NO: 92469 - RNA, 1698 nt, Artificial Sequence; identical to SEQ ID NO: 92312
  derived and/or modified sequence opt2 from hemagglutinin__InfluenzaA__ABF82940

SEQ ID NO: 92470 - RNA, 1701 nt, Artificial Sequence
  derived and/or modified sequence opt2 from hemagglutinin__InfluenzaA__ABF83447
augaagaccaucaucgcccucuccuacaucuucugccucgcccucggccaggaccuccccggcaacgacaacaacaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggcggcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 92471 - RNA, 1644 nt, Artificial Sequence
  derived and/or modified sequence opt2 from hemagglutinin__InfluenzaA__ABG20468
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugcgagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 92472 - RNA, 1707 nt, Artificial Sequence
  derived and/or modified sequence opt2 from hemagglutinin__InfluenzaA__ABG20472
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaaggcccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 92473 - RNA, 1707 nt, Artificial Sequence
  derived and/or modified sequence opt2 from hemagglutinin__InfluenzaA__ABG20478
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 92474 - RNA, 1701 nt, Artificial Sequence; identical to SEQ ID NO: 92295
  derived and/or modified sequence opt2 from hemagglutinin__InfluenzaA__ABG26758

SEQ ID NO: 92475 - RNA, 1701 nt, Artificial Sequence
  derived and/or modified sequence opt2 from hemagglutinin__InfluenzaA__ABG26769
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92476 - RNA, 1701 nt, Artificial Sequence; identical to SEQ ID NO: 92423
  derived and/or modified sequence opt2 from hemagglutinin__InfluenzaA__ABG26780

SEQ ID NO: 92477 - RNA, 1701 nt, Artificial Sequence
  derived and/or modified sequence opt2 from hemagglutinin__InfluenzaA__ABG26791
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcucaaggagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92478 - RNA, 1701 nt, Artificial Sequence
  derived and/or modified sequence opt2 from hemagglutinin__InfluenzaA__ABG26802
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacgaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccggcugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaugaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92479 - RNA, 1701 nt, Artificial Sequence; identical to SEQ ID NO: 92427
  derived and/or modified sequence opt2 from hemagglutinin__InfluenzaA__ABG26813

SEQ ID NO: 92480 - RNA, 1701 nt, Artificial Sequence
  derived and/or modified sequence opt2 from hemagglutinin__InfluenzaA__ABG26824
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugcaagaucugcaucuga

SEQ ID NO: 92481 - RNA, 1701 nt, Artificial Sequence; identical to SEQ ID NO: 92433
  derived and/or modified sequence opt2 from hemagglutinin__InfluenzaA__ABG26835

SEQ ID NO: 92482 - RNA, 1701 nt, Artificial Sequence
  derived and/or modified sequence opt2 from hemagglutinin__InfluenzaA__ABG26890
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92483 - RNA, 1701 nt, Artificial Sequence
  derived and/or modified sequence opt2 from hemagglutinin__InfluenzaA__ABG26901
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacuccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92484 - RNA, 1701 nt, Artificial Sequence
  derived and/or modified sequence opt2 from hemagglutinin__InfluenzaA__ABG26912
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucuccaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92485 - RNA, 1698 nt, Artificial Sequence
  derived and/or modified sequence opt2 from hemagglutinin__InfluenzaA__ABG26945
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccuccggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92486 - RNA, 1701 nt, Artificial Sequence
  derived and/or modified sequence opt2 from hemagglutinin__InfluenzaA__ABG26956
augaagaccaucaucgcccucuccuacauccucugccucgucuucgcccagaagcuccccggcaacgacaaccgcaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucuccaagcucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92487 - RNA, 1698 nt, Artificial Sequence
  derived and/or modified sequence opt2 from hemagglutinin__InfluenzaA__ABG37120
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92488 - RNA, 1701 nt, Artificial Sequence
  derived and/or modified sequence opt2 from hemagglutinin__InfluenzaA__ABG37131
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacggcccccaccagauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaguccuucaacuggaccggcgucgcccagaacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaguccuccggccgcgucaccgucuccaccaagcgcucccagcagaccgucacccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgccgcggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92489 - RNA, 1701 nt, Artificial Sequence; identical to SEQ ID NO: 92295
  derived and/or modified sequence opt2 from hemagglutinin__InfluenzaA__ABG37142

SEQ ID NO: 92490 - RNA, 1701 nt, Artificial Sequence
  derived and/or modified sequence opt2 from hemagglutinin__InfluenzaA__ABG37164
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacgacuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92491 - RNA, 1701 nt, Artificial Sequence
  derived and/or modified sequence opt2 from hemagglutinin__InfluenzaA__ABG37175
augaagaccaucaucgcccucuccuacauccucugccaggucuucgccaagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92492 - RNA, 1701 nt, Artificial Sequence
  derived and/or modified sequence opt2 from hemagglutinin__InfluenzaA__ABG37186
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcgucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuacaaggacgaggcccucaacaaccgcuuccagaucaagggcgucguccucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92493 - RNA, 1701 nt, Artificial Sequence
  derived and/or modified sequence opt2 from hemagglutinin__InfluenzaA__ABG37197
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaacggcgucgcccaggacggcaaguccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92494 - RNA, 1701 nt, Artificial Sequence
  derived and/or modified sequence opt2 from hemagglutinin__InfluenzaA__ABG37208
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccggcugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaugaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92495 - RNA, 1701 nt, Artificial Sequence
  derived and/or modified sequence opt2 from hemagglutinin__InfluenzaA__ABG37230
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccaccaguccaaguacaaguaccccgagcucaacgucaccaugcccaacaacggcaaguucgacaagcucuacaucuggggcguccaccaccccuccaccgacuccgaccagaccucccucuacgcccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92496 - RNA, 1701 nt, Artificial Sequence
  derived and/or modified sequence opt2 from hemagglutinin__InfluenzaA__ABG37241
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92497 - RNA, 1701 nt, Artificial Sequence
  derived and/or modified sequence opt2 from hemagglutinin__InfluenzaA__ABG37252
augaagaccaucaucgcccucuccuacauccucugccucgucuucgcccagaagcucaccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92498 - RNA, 1701 nt, Artificial Sequence
  derived and/or modified sequence opt2 from hemagglutinin__InfluenzaA__ABG37263
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92499 - RNA, 1701 nt, Artificial Sequence
  derived and/or modified sequence opt2 from hemagglutinin__InfluenzaA__ABG37274
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaucucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucuccuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92500 - RNA, 1701 nt, Artificial Sequence
  derived and/or modified sequence opt2 from hemagglutinin__InfluenzaA__ABG37285
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgacuacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcuucguccuccucggcuucaucaugugggccugccagaagggcaacauccgcugcaacaucugcaucuga

SEQ ID NO: 92501 - RNA, 1701 nt, Artificial Sequence
  derived and/or modified sequence opt2 from hemagglutinin__InfluenzaA__ABG37296
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92502 - RNA, 1701 nt, Artificial Sequence; identical to SEQ ID NO: 92496
  derived and/or modified sequence opt2 from hemagglutinin__InfluenzaA__ABG37307

SEQ ID NO: 92503 - RNA, 1701 nt, Artificial Sequence; identical to SEQ ID NO: 92501
  derived and/or modified sequence opt2 from hemagglutinin__InfluenzaA__ABG37318

SEQ ID NO: 92504 - RNA, 1701 nt, Artificial Sequence
  derived and/or modified sequence opt2 from hemagglutinin__InfluenzaA__ABG37329
augaagaccaucaucgcccucuccuacauccucugccucgucuucgcccagaagcuccccgagaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92505 - RNA, 1701 nt, Artificial Sequence
  derived and/or modified sequence opt2 from hemagglutinin__InfluenzaA__ABG37340
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuuccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92506 - RNA, 1701 nt, Artificial Sequence
  derived and/or modified sequence opt2 from hemagglutinin__InfluenzaA__ABG37351
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucgacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92507 - RNA, 1698 nt, Artificial Sequence
  derived and/or modified sequence opt2 from hemagglutinin__InfluenzaA__ABG37362
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92508 - RNA, 1698 nt, Artificial Sequence; identical to SEQ ID NO: 92312
  derived and/or modified sequence opt2 from hemagglutinin__InfluenzaA__ABG37384

SEQ ID NO: 92509 - RNA, 1698 nt, Artificial Sequence; identical to SEQ ID NO: 92382
  derived and/or modified sequence opt2 from hemagglutinin__InfluenzaA__ABG37395

SEQ ID NO: 92510 - RNA, 1701 nt, Artificial Sequence; identical to SEQ ID NO: 92289
  derived and/or modified sequence opt2 from hemagglutinin__InfluenzaA__ABG37406

SEQ ID NO: 92511 - RNA, 1701 nt, Artificial Sequence
  derived and/or modified sequence opt2 from hemagglutinin__InfluenzaA__ABG37428
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaagucccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92512 - RNA, 1701 nt, Artificial Sequence; identical to SEQ ID NO: 92074
  derived and/or modified sequence opt2 from hemagglutinin__InfluenzaA__ABG37439

SEQ ID NO: 92513 - RNA, 1701 nt, Artificial Sequence; identical to SEQ ID NO: 92152
  derived and/or modified sequence opt2 from hemagglutinin__InfluenzaA__ABG37461

SEQ ID NO: 92514 - RNA, 1701 nt, Artificial Sequence
  derived and/or modified sequence opt2 from hemagglutinin__InfluenzaA__ABG37472
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagguccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92515 - RNA, 1701 nt, Artificial Sequence; identical to SEQ ID NO: 92074
  derived and/or modified sequence opt2 from hemagglutinin__InfluenzaA__ABG37483

SEQ ID NO: 92516 - RNA, 1701 nt, Artificial Sequence; identical to SEQ ID NO: 92152
  derived and/or modified sequence opt2 from hemagglutinin__InfluenzaA__ABG37494

SEQ ID NO: 92517 - RNA, 1701 nt, Artificial Sequence
  derived and/or modified sequence opt2 from hemagglutinin__InfluenzaA__ABG37505
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggccucugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92518 - RNA, 1701 nt, Artificial Sequence; identical to SEQ ID NO: 92028
  derived and/or modified sequence opt2 from hemagglutinin__InfluenzaA__ABG37516

SEQ ID NO: 92519 - RNA, 1701 nt, Artificial Sequence; identical to SEQ ID NO: 92028
  derived and/or modified sequence opt2 from hemagglutinin__InfluenzaA__ABG37527

SEQ ID NO: 92520 - RNA, 1701 nt, Artificial Sequence; identical to SEQ ID NO: 92028
  derived and/or modified sequence opt2 from hemagglutinin__InfluenzaA__ABG37538

SEQ ID NO: 92521 - RNA, 1701 nt, Artificial Sequence; identical to SEQ ID NO: 92028
  derived and/or modified sequence opt2 from hemagglutinin__InfluenzaA__ABG37549

SEQ ID NO: 92522 - RNA, 1701 nt, Artificial Sequence; identical to SEQ ID NO: 92028
  derived and/or modified sequence opt2 from hemagglutinin__InfluenzaA__ABG37560

SEQ ID NO: 92523 - RNA, 1701 nt, Artificial Sequence; identical to SEQ ID NO: 92028
  derived and/or modified sequence opt2 from hemagglutinin__InfluenzaA__ABG37571

SEQ ID NO: 92524 - RNA, 1701 nt, Artificial Sequence
  derived and/or modified sequence opt2 from hemagglutinin__InfluenzaA__ABG37582
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92525 - RNA, 1701 nt, Artificial Sequence; identical to SEQ ID NO: 92028
  derived and/or modified sequence opt2 from hemagglutinin__InfluenzaA__ABG37604

SEQ ID NO: 92526 - RNA, 1701 nt, Artificial Sequence; identical to SEQ ID NO: 92028
  derived and/or modified sequence opt2 from hemagglutinin__InfluenzaA__ABG37615

SEQ ID NO: 92527 - RNA, 1698 nt, Artificial Sequence; identical to SEQ ID NO: 92254
  derived and/or modified sequence opt2 from hemagglutinin__InfluenzaA__ABG47807

SEQ ID NO: 92528 - RNA, 1698 nt, Artificial Sequence; identical to SEQ ID NO: 92253
  derived and/or modified sequence opt2 from hemagglutinin__InfluenzaA__ABG47818

SEQ ID NO: 92529 - RNA, 1701 nt, Artificial Sequence
  derived and/or modified sequence opt2 from hemagglutinin__InfluenzaA__ABG47829
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucaccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92530 - RNA, 1701 nt, Artificial Sequence
  derived and/or modified sequence opt2 from hemagglutinin__InfluenzaA__ABG47840
augaaggucaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauguccgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92531 - RNA, 1701 nt, Artificial Sequence
  derived and/or modified sequence opt2 from hemagglutinin__InfluenzaA__ABG47851
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 92532 - RNA, 1701 nt, Artificial Sequence
  derived and/or modified sequence opt2 from hemagglutinin__InfluenzaA__ABG47862
augcgcaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucaucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92533 - RNA, 1701 nt, Artificial Sequence; identical to SEQ ID NO: 92496
  derived and/or modified sequence opt2 from hemagglutinin__InfluenzaA__ABG47873

SEQ ID NO: 92534 - RNA, 1701 nt, Artificial Sequence; identical to SEQ ID NO: 92501
  derived and/or modified sequence opt2 from hemagglutinin__InfluenzaA__ABG47895

SEQ ID NO: 92535 - RNA, 1701 nt, Artificial Sequence; identical to SEQ ID NO: 92496
  derived and/or modified sequence opt2 from hemagglutinin__InfluenzaA__ABG47906

SEQ ID NO: 92536 - RNA, 1701 nt, Artificial Sequence
  derived and/or modified sequence opt2 from hemagglutinin__InfluenzaA__ABG47917
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92537 - RNA, 1701 nt, Artificial Sequence; identical to SEQ ID NO: 92536
  derived and/or modified sequence opt2 from hemagglutinin__InfluenzaA__ABG47928

SEQ ID NO: 92538 - RNA, 1701 nt, Artificial Sequence
  derived and/or modified sequence opt2 from hemagglutinin__InfluenzaA__ABG47939
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacucccccuaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92539 - RNA, 1701 nt, Artificial Sequence
  derived and/or modified sequence opt2 from hemagglutinin__InfluenzaA__ABG47950
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccucccucggcacccucgaguucaucaacgaggacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacgcccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaacugcuccuccgagugcaucacccccaacggcaacauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggcuuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92540 - RNA, 1701 nt, Artificial Sequence
  derived and/or modified sequence opt2 from hemagglutinin__InfluenzaA__ABG47961
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcggcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagaugcgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92541 - RNA, 1701 nt, Artificial Sequence; identical to SEQ ID NO: 92536
  derived and/or modified sequence opt2 from hemagglutinin__InfluenzaA__ABG47972

SEQ ID NO: 92542 - RNA, 1701 nt, Artificial Sequence; identical to SEQ ID NO: 92536
  derived and/or modified sequence opt2 from hemagglutinin__InfluenzaA__ABG47983

SEQ ID NO: 92543 - RNA, 1701 nt, Artificial Sequence; identical to SEQ ID NO: 92536
  derived and/or modified sequence opt2 from hemagglutinin__InfluenzaA__ABG47994

SEQ ID NO: 92544 - RNA, 1701 nt, Artificial Sequence
  derived and/or modified sequence opt2 from hemagglutinin__InfluenzaA__ABG48005
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92545 - RNA, 1701 nt, Artificial Sequence; identical to SEQ ID NO: 92536
  derived and/or modified sequence opt2 from hemagglutinin__InfluenzaA__ABG48016

SEQ ID NO: 92546 - RNA, 1701 nt, Artificial Sequence; identical to SEQ ID NO: 92536
  derived and/or modified sequence opt2 from hemagglutinin__InfluenzaA__ABG48027

SEQ ID NO: 92547 - RNA, 1698 nt, Artificial Sequence
  derived and/or modified sequence opt2 from hemagglutinin__InfluenzaA__ABG48049
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccacccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92548 - RNA, 1701 nt, Artificial Sequence; identical to SEQ ID NO: 92162
  derived and/or modified sequence opt2 from hemagglutinin__InfluenzaA__ABG48060

SEQ ID NO: 92549 - RNA, 1701 nt, Artificial Sequence; identical to SEQ ID NO: 92162
  derived and/or modified sequence opt2 from hemagglutinin__InfluenzaA__ABG48071

SEQ ID NO: 92550 - RNA, 1701 nt, Artificial Sequence
  derived and/or modified sequence opt2 from hemagglutinin__InfluenzaA__ABG48082
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccuccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92551 - RNA, 1701 nt, Artificial Sequence
  derived and/or modified sequence opt2 from hemagglutinin__InfluenzaA__ABG48104
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92552 - RNA, 1701 nt, Artificial Sequence; identical to SEQ ID NO: 92152
  derived and/or modified sequence opt2 from hemagglutinin__InfluenzaA__ABG48115

SEQ ID NO: 92553 - RNA, 1701 nt, Artificial Sequence; identical to SEQ ID NO: 92159
  derived and/or modified sequence opt2 from hemagglutinin__InfluenzaA__ABG48126

SEQ ID NO: 92554 - RNA, 1701 nt, Artificial Sequence; identical to SEQ ID NO: 92074
  derived and/or modified sequence opt2 from hemagglutinin__InfluenzaA__ABG48148

SEQ ID NO: 92555 - RNA, 1701 nt, Artificial Sequence; identical to SEQ ID NO: 92074
  derived and/or modified sequence opt2 from hemagglutinin__InfluenzaA__ABG48159

SEQ ID NO: 92556 - RNA, 1701 nt, Artificial Sequence
  derived and/or modified sequence opt2 from hemagglutinin__InfluenzaA__ABG48170
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuucgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92557 - RNA, 1701 nt, Artificial Sequence
  derived and/or modified sequence opt2 from hemagglutinin__InfluenzaA__ABG48181
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuacgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92558 - RNA, 1701 nt, Artificial Sequence; identical to SEQ ID NO: 92074
  derived and/or modified sequence opt2 from hemagglutinin__InfluenzaA__ABG48192

SEQ ID NO: 92559 - RNA, 1701 nt, Artificial Sequence
  derived and/or modified sequence opt2 from hemagglutinin__InfluenzaA__ABG48203
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacgucugcaucuga

SEQ ID NO: 92560 - RNA, 1701 nt, Artificial Sequence; identical to SEQ ID NO: 92028
  derived and/or modified sequence opt2 from hemagglutinin__InfluenzaA__ABG48214

SEQ ID NO: 92561 - RNA, 1701 nt, Artificial Sequence; identical to SEQ ID NO: 92028
  derived and/or modified sequence opt2 from hemagglutinin__InfluenzaA__ABG48236

SEQ ID NO: 92562 - RNA, 1701 nt, Artificial Sequence
  derived and/or modified sequence opt2 from hemagglutinin__InfluenzaA__ABG48247
augaagaccaucaucgcccucuccuacauccucugccucgucuucgcccagaagcuccccggcaacgacaacaacaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92563 - RNA, 1701 nt, Artificial Sequence
  derived and/or modified sequence opt2 from hemagglutinin__InfluenzaA__ABG48269
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccucccccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92564 - RNA, 1701 nt, Artificial Sequence
  derived and/or modified sequence opt2 from hemagglutinin__InfluenzaA__ABG48291
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaaguccgaguacaaguaccccgcccucaacgucuccaugcccaacaacggcaaguucaacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuucgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92565 - RNA, 1701 nt, Artificial Sequence
  derived and/or modified sequence opt2 from hemagglutinin__InfluenzaA__ABG48335
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92566 - RNA, 1701 nt, Artificial Sequence
  derived and/or modified sequence opt2 from hemagglutinin__InfluenzaA__ABG48346
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcaacaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgaccgccccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92567 - RNA, 1701 nt, Artificial Sequence; identical to SEQ ID NO: 92565
  derived and/or modified sequence opt2 from hemagglutinin__InfluenzaA__ABG48357

SEQ ID NO: 92568 - RNA, 1701 nt, Artificial Sequence
  derived and/or modified sequence opt2 from hemagglutinin__InfluenzaA__ABG48368
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaaggucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92569 - RNA, 1701 nt, Artificial Sequence; identical to SEQ ID NO: 92419
  derived and/or modified sequence opt2 from hemagglutinin__InfluenzaA__ABG67135

SEQ ID NO: 92570 - RNA, 1701 nt, Artificial Sequence; identical to SEQ ID NO: 92295
  derived and/or modified sequence opt2 from hemagglutinin__InfluenzaA__ABG67146

SEQ ID NO: 92571 - RNA, 1701 nt, Artificial Sequence
  derived and/or modified sequence opt2 from hemagglutinin__InfluenzaA__ABG67157
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcaacuccccccaccgcaucaucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagcuccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92572 - RNA, 1701 nt, Artificial Sequence; identical to SEQ ID NO: 92496
  derived and/or modified sequence opt2 from hemagglutinin__InfluenzaA__ABG67168

SEQ ID NO: 92573 - RNA, 1701 nt, Artificial Sequence; identical to SEQ ID NO: 92496
  derived and/or modified sequence opt2 from hemagglutinin__InfluenzaA__ABG67179

SEQ ID NO: 92574 - RNA, 1701 nt, Artificial Sequence
  derived and/or modified sequence opt2 from hemagglutinin__InfluenzaA__ABG67190
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuuccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92575 - RNA, 1701 nt, Artificial Sequence
  derived and/or modified sequence opt2 from hemagglutinin__InfluenzaA__ABG67212
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguaccgcuaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92576 - RNA, 1701 nt, Artificial Sequence; identical to SEQ ID NO: 92536
  derived and/or modified sequence opt2 from hemagglutinin__InfluenzaA__ABG67223

SEQ ID NO: 92577 - RNA, 1701 nt, Artificial Sequence
  derived and/or modified sequence opt2 from hemagglutinin__InfluenzaA__ABG67234
augaagaccaucaucgcccucuccuacauccucugccucgucuucgcccagaagcuccccggcgacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucgagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92578 - RNA, 1701 nt, Artificial Sequence
  derived and/or modified sequence opt2 from hemagglutinin__InfluenzaA__ABG67245
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucgacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92579 - RNA, 1698 nt, Artificial Sequence; identical to SEQ ID NO: 92254
  derived and/or modified sequence opt2 from hemagglutinin__InfluenzaA__ABG67477

SEQ ID NO: 92580 - RNA, 1698 nt, Artificial Sequence; identical to SEQ ID NO: 92312
  derived and/or modified sequence opt2 from hemagglutinin__InfluenzaA__ABG67491

SEQ ID NO: 92581 - RNA, 1701 nt, Artificial Sequence
  derived and/or modified sequence opt2 from hemagglutinin__InfluenzaA__ABG67502
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacgucuccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92582 - RNA, 1701 nt, Artificial Sequence
  derived and/or modified sequence opt2 from hemagglutinin__InfluenzaA__ABG67524
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccgucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92583 - RNA, 1701 nt, Artificial Sequence; identical to SEQ ID NO: 92074
  derived and/or modified sequence opt2 from hemagglutinin__InfluenzaA__ABG67535

SEQ ID NO: 92584 - RNA, 1701 nt, Artificial Sequence; identical to SEQ ID NO: 92028
  derived and/or modified sequence opt2 from hemagglutinin__InfluenzaA__ABG67546

SEQ ID NO: 92585 - RNA, 1701 nt, Artificial Sequence
  derived and/or modified sequence opt2 from hemagglutinin__InfluenzaA__ABG67557
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccaccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92586 - RNA, 1701 nt, Artificial Sequence; identical to SEQ ID NO: 92028
  derived and/or modified sequence opt2 from hemagglutinin__InfluenzaA__ABG67568

SEQ ID NO: 92587 - RNA, 1701 nt, Artificial Sequence; identical to SEQ ID NO: 92028
  derived and/or modified sequence opt2 from hemagglutinin__InfluenzaA__ABG67579

SEQ ID NO: 92588 - RNA, 1701 nt, Artificial Sequence; identical to SEQ ID NO: 92028
  derived and/or modified sequence opt2 from hemagglutinin__InfluenzaA__ABG67590

SEQ ID NO: 92589 - RNA, 1701 nt, Artificial Sequence; identical to SEQ ID NO: 92028
  derived and/or modified sequence opt2 from hemagglutinin__InfluenzaA__ABG67601

SEQ ID NO: 92590 - RNA, 1701 nt, Artificial Sequence; identical to SEQ ID NO: 92028
  derived and/or modified sequence opt2 from hemagglutinin__InfluenzaA__ABG67612

SEQ ID NO: 92591 - RNA, 1701 nt, Artificial Sequence; identical to SEQ ID NO: 92028
  derived and/or modified sequence opt2 from hemagglutinin__InfluenzaA__ABG67623

SEQ ID NO: 92592 - RNA, 1701 nt, Artificial Sequence
  derived and/or modified sequence opt2 from hemagglutinin__InfluenzaA__ABG67634
augaagaccaucaucgcccucuccuacauccucugccucgucuucgcccagaagcuccccggcaacgacaacaacaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccaagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92593 - RNA, 1701 nt, Artificial Sequence; identical to SEQ ID NO: 92028
  derived and/or modified sequence opt2 from hemagglutinin__InfluenzaA__ABG67645

SEQ ID NO: 92594 - RNA, 1701 nt, Artificial Sequence
  derived and/or modified sequence opt2 from hemagglutinin__InfluenzaA__ABG67656
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92595 - RNA, 1701 nt, Artificial Sequence
  derived and/or modified sequence opt2 from hemagglutinin__InfluenzaA__ABG67667
augaagaccaucaucgcccucuccuacauccucugccaggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaucggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92596 - RNA, 1701 nt, Artificial Sequence
  derived and/or modified sequence opt2 from hemagglutinin__InfluenzaA__ABG79941
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcuccaucugcaucuga

SEQ ID NO: 92597 - RNA, 1701 nt, Artificial Sequence; identical to SEQ ID NO: 92433
  derived and/or modified sequence opt2 from hemagglutinin__InfluenzaA__ABG79952

SEQ ID NO: 92598 - RNA, 1701 nt, Artificial Sequence; identical to SEQ ID NO: 92496
  derived and/or modified sequence opt2 from hemagglutinin__InfluenzaA__ABG79974

SEQ ID NO: 92599 - RNA, 1701 nt, Artificial Sequence; identical to SEQ ID NO: 92496
  derived and/or modified sequence opt2 from hemagglutinin__InfluenzaA__ABG79985

SEQ ID NO: 92600 - RNA, 1701 nt, Artificial Sequence
  derived and/or modified sequence opt2 from hemagglutinin__InfluenzaA__ABG79996
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92601 - RNA, 1701 nt, Artificial Sequence; identical to SEQ ID NO: 92496
  derived and/or modified sequence opt2 from hemagglutinin__InfluenzaA__ABG80007

SEQ ID NO: 92602 - RNA, 1701 nt, Artificial Sequence; identical to SEQ ID NO: 92496
  derived and/or modified sequence opt2 from hemagglutinin__InfluenzaA__ABG80018

SEQ ID NO: 92603 - RNA, 1701 nt, Artificial Sequence; identical to SEQ ID NO: 92501
  derived and/or modified sequence opt2 from hemagglutinin__InfluenzaA__ABG80029

SEQ ID NO: 92604 - RNA, 1701 nt, Artificial Sequence; identical to SEQ ID NO: 92501
  derived and/or modified sequence opt2 from hemagglutinin__InfluenzaA__ABG80040

SEQ ID NO: 92605 - RNA, 1701 nt, Artificial Sequence; identical to SEQ ID NO: 92496
  derived and/or modified sequence opt2 from hemagglutinin__InfluenzaA__ABG80051

SEQ ID NO: 92606 - RNA, 1701 nt, Artificial Sequence
  derived and/or modified sequence opt2 from hemagglutinin__InfluenzaA__ABG80062
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagaccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92607 - RNA, 1701 nt, Artificial Sequence
  derived and/or modified sequence opt2 from hemagglutinin__InfluenzaA__ABG80073
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgaccccaacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92608 - RNA, 1701 nt, Artificial Sequence
  derived and/or modified sequence opt2 from hemagglutinin__InfluenzaA__ABG80084
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccuccggcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacaucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92609 - RNA, 1701 nt, Artificial Sequence
  derived and/or modified sequence opt2 from hemagglutinin__InfluenzaA__ABG80095
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaggucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92610 - RNA, 1701 nt, Artificial Sequence; identical to SEQ ID NO: 92536
  derived and/or modified sequence opt2 from hemagglutinin__InfluenzaA__ABG80106

SEQ ID NO: 92611 - RNA, 1701 nt, Artificial Sequence
  derived and/or modified sequence opt2 from hemagglutinin__InfluenzaA__ABG80117
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgucaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92612 - RNA, 1701 nt, Artificial Sequence
  derived and/or modified sequence opt2 from hemagglutinin__InfluenzaA__ABG80128
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccgcaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92613 - RNA, 1701 nt, Artificial Sequence
  derived and/or modified sequence opt2 from hemagglutinin__InfluenzaA__ABG80139
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuacgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92614 - RNA, 1701 nt, Artificial Sequence
  derived and/or modified sequence opt2 from hemagglutinin__InfluenzaA__ABG80150
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccuccggcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92615 - RNA, 1701 nt, Artificial Sequence
  derived and/or modified sequence opt2 from hemagglutinin__InfluenzaA__ABG80161
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccaggccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92616 - RNA, 1698 nt, Artificial Sequence
  derived and/or modified sequence opt2 from hemagglutinin__InfluenzaA__ABG80172
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacaacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92617 - RNA, 1698 nt, Artificial Sequence
  derived and/or modified sequence opt2 from hemagglutinin__InfluenzaA__ABG80183
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcggccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92618 - RNA, 1701 nt, Artificial Sequence
  derived and/or modified sequence opt2 from hemagglutinin__InfluenzaA__ABG80194
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggaguggaaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92619 - RNA, 1701 nt, Artificial Sequence
  derived and/or modified sequence opt2 from hemagglutinin__InfluenzaA__ABG80205
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucaaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92620 - RNA, 1701 nt, Artificial Sequence
  derived and/or modified sequence opt2 from hemagglutinin__InfluenzaA__ABG80216
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccucccccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92621 - RNA, 1701 nt, Artificial Sequence; identical to SEQ ID NO: 92152
  derived and/or modified sequence opt2 from hemagglutinin__InfluenzaA__ABG80227

SEQ ID NO: 92622 - RNA, 1701 nt, Artificial Sequence; identical to SEQ ID NO: 92028
  derived and/or modified sequence opt2 from hemagglutinin__InfluenzaA__ABG80238

SEQ ID NO: 92623 - RNA, 1701 nt, Artificial Sequence; identical to SEQ ID NO: 92028
  derived and/or modified sequence opt2 from hemagglutinin__InfluenzaA__ABG80249

SEQ ID NO: 92624 - RNA, 1701 nt, Artificial Sequence; identical to SEQ ID NO: 92028
  derived and/or modified sequence opt2 from hemagglutinin__InfluenzaA__ABG80260

SEQ ID NO: 92625 - RNA, 1701 nt, Artificial Sequence
  derived and/or modified sequence opt2 from hemagglutinin__InfluenzaA__ABG80271
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucauggacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92626 - RNA, 1701 nt, Artificial Sequence; identical to SEQ ID NO: 92103
  derived and/or modified sequence opt2 from hemagglutinin__InfluenzaA__ABG80282

SEQ ID NO: 92627 - RNA, 1701 nt, Artificial Sequence; identical to SEQ ID NO: 91755
  derived and/or modified sequence opt2 from hemagglutinin__InfluenzaA__ABG80293

SEQ ID NO: 92628 - RNA, 1701 nt, Artificial Sequence
  derived and/or modified sequence opt2 from hemagglutinin__InfluenzaA__ABG80304
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucaaccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92629 - RNA, 1701 nt, Artificial Sequence
  derived and/or modified sequence opt2 from hemagglutinin__InfluenzaA__ABG80315
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucauccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92630 - RNA, 1701 nt, Artificial Sequence; identical to SEQ ID NO: 91794
  derived and/or modified sequence opt2 from hemagglutinin__InfluenzaA__ABG80326

SEQ ID NO: 92631 - RNA, 1701 nt, Artificial Sequence; identical to SEQ ID NO: 91794
  derived and/or modified sequence opt2 from hemagglutinin__InfluenzaA__ABG80337

SEQ ID NO: 92632 - RNA, 1701 nt, Artificial Sequence
  derived and/or modified sequence opt2 from hemagglutinin__InfluenzaA__ABG80359
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccuccgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccgucgaccagaucaacggcaagcucaaccgccucaucgagcgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92633 - RNA, 1701 nt, Artificial Sequence
  derived and/or modified sequence opt2 from hemagglutinin__InfluenzaA__ABG80370
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92634 - RNA, 1701 nt, Artificial Sequence; identical to SEQ ID NO: 92565
  derived and/or modified sequence opt2 from hemagglutinin__InfluenzaA__ABG80392

SEQ ID NO: 92635 - RNA, 1701 nt, Artificial Sequence; identical to SEQ ID NO: 92565
  derived and/or modified sequence opt2 from hemagglutinin__InfluenzaA__ABG80403

SEQ ID NO: 92636 - RNA, 1701 nt, Artificial Sequence; identical to SEQ ID NO: 92565
  derived and/or modified sequence opt2 from hemagglutinin__InfluenzaA__ABG80414

SEQ ID NO: 92637 - RNA, 1701 nt, Artificial Sequence; identical to SEQ ID NO: 92565
  derived and/or modified sequence opt2 from hemagglutinin__InfluenzaA__ABG80425

SEQ ID NO: 92638 - RNA, 1701 nt, Artificial Sequence; identical to SEQ ID NO: 92295
  derived and/or modified sequence opt2 from hemagglutinin__InfluenzaA__ABG88289

SEQ ID NO: 92639 - RNA, 1701 nt, Artificial Sequence
  derived and/or modified sequence opt2 from hemagglutinin__InfluenzaA__ABG88300
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccgaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92640 - RNA, 1701 nt, Artificial Sequence; identical to SEQ ID NO: 92423
  derived and/or modified sequence opt2 from hemagglutinin__InfluenzaA__ABG88311

SEQ ID NO: 92641 - RNA, 1701 nt, Artificial Sequence
  derived and/or modified sequence opt2 from hemagglutinin__InfluenzaA__ABG88322
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccauccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92642 - RNA, 1701 nt, Artificial Sequence
  derived and/or modified sequence opt2 from hemagglutinin__InfluenzaA__ABG88333
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucuccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92643 - RNA, 1701 nt, Artificial Sequence
  derived and/or modified sequence opt2 from hemagglutinin__InfluenzaA__ABG88344
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucuccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92644 - RNA, 1701 nt, Artificial Sequence
  derived and/or modified sequence opt2 from hemagglutinin__InfluenzaA__ABG88355
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcgaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92645 - RNA, 1701 nt, Artificial Sequence
  derived and/or modified sequence opt2 from hemagglutinin__InfluenzaA__ABG88366
augaagaccaucaucgcccucuccuacuuccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92646 - RNA, 1701 nt, Artificial Sequence; identical to SEQ ID NO: 92496
  derived and/or modified sequence opt2 from hemagglutinin__InfluenzaA__ABG88377

SEQ ID NO: 92647 - RNA, 1701 nt, Artificial Sequence; identical to SEQ ID NO: 92496
  derived and/or modified sequence opt2 from hemagglutinin__InfluenzaA__ABG88388

SEQ ID NO: 92648 - RNA, 1701 nt, Artificial Sequence
  derived and/or modified sequence opt2 from hemagglutinin__InfluenzaA__ABG88399
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggaguccuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92649 - RNA, 1701 nt, Artificial Sequence; identical to SEQ ID NO: 92536
  derived and/or modified sequence opt2 from hemagglutinin__InfluenzaA__ABG88410

SEQ ID NO: 92650 - RNA, 1701 nt, Artificial Sequence; identical to SEQ ID NO: 92536
  derived and/or modified sequence opt2 from hemagglutinin__InfluenzaA__ABG88421

SEQ ID NO: 92651 - RNA, 1701 nt, Artificial Sequence
  derived and/or modified sequence opt2 from hemagglutinin__InfluenzaA__ABG88432
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagaugcgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92652 - RNA, 1701 nt, Artificial Sequence; identical to SEQ ID NO: 92536
  derived and/or modified sequence opt2 from hemagglutinin__InfluenzaA__ABG88443

SEQ ID NO: 92653 - RNA, 1701 nt, Artificial Sequence
  derived and/or modified sequence opt2 from hemagglutinin__InfluenzaA__ABG88454
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgccaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcggcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgacaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92654 - RNA, 1701 nt, Artificial Sequence
  derived and/or modified sequence opt2 from hemagglutinin__InfluenzaA__ABG88465
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92655 - RNA, 1701 nt, Artificial Sequence; identical to SEQ ID NO: 92536
  derived and/or modified sequence opt2 from hemagglutinin__InfluenzaA__ABG88476

SEQ ID NO: 92656 - RNA, 1701 nt, Artificial Sequence; identical to SEQ ID NO: 92536
  derived and/or modified sequence opt2 from hemagglutinin__InfluenzaA__ABG88487

SEQ ID NO: 92657 - RNA, 1701 nt, Artificial Sequence; identical to SEQ ID NO: 92536
  derived and/or modified sequence opt2 from hemagglutinin__InfluenzaA__ABG88498

SEQ ID NO: 92658 - RNA, 1701 nt, Artificial Sequence; identical to SEQ ID NO: 92536
  derived and/or modified sequence opt2 from hemagglutinin__InfluenzaA__ABG88509

SEQ ID NO: 92659 - RNA, 1701 nt, Artificial Sequence
  derived and/or modified sequence opt2 from hemagglutinin__InfluenzaA__ABG88520
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaccaugugggccugccagaagggcaacauccgcugcaacaucugcaucuga

SEQ ID NO: 92660 - RNA, 1701 nt, Artificial Sequence
  derived and/or modified sequence opt2 from hemagglutinin__InfluenzaA__ABG88531
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccguccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92661 - RNA, 1698 nt, Artificial Sequence; identical to SEQ ID NO: 92547
  derived and/or modified sequence opt2 from hemagglutinin__InfluenzaA__ABG88553

SEQ ID NO: 92662 - RNA, 1701 nt, Artificial Sequence; identical to SEQ ID NO: 92222
  derived and/or modified sequence opt2 from hemagglutinin__InfluenzaA__ABG88564

SEQ ID NO: 92663 - RNA, 1701 nt, Artificial Sequence; identical to SEQ ID NO: 92252
  derived and/or modified sequence opt2 from hemagglutinin__InfluenzaA__ABG88575

SEQ ID NO: 92664 - RNA, 1701 nt, Artificial Sequence; identical to SEQ ID NO: 92162
  derived and/or modified sequence opt2 from hemagglutinin__InfluenzaA__ABG88586

SEQ ID NO: 92665 - RNA, 1701 nt, Artificial Sequence
  derived and/or modified sequence opt2 from hemagglutinin__InfluenzaA__ABG88597
augaagaccaucaucgcccucuccuacauccucugccucgucuucgcccagaagcuccccgccaacgacaacuccaccgccacccucugccucggccaccacgccguccccaacggcacccucgucaagaccaucaccaacgacaacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92666 - RNA, 1701 nt, Artificial Sequence
  derived and/or modified sequence opt2 from hemagglutinin__InfluenzaA__ABG88608
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacacccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92667 - RNA, 1701 nt, Artificial Sequence; identical to SEQ ID NO: 92074
  derived and/or modified sequence opt2 from hemagglutinin__InfluenzaA__ABG88619

SEQ ID NO: 92668 - RNA, 1701 nt, Artificial Sequence
  derived and/or modified sequence opt2 from hemagglutinin__InfluenzaA__ABG88630
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagguccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92669 - RNA, 1701 nt, Artificial Sequence
  derived and/or modified sequence opt2 from hemagglutinin__InfluenzaA__ABG88641
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcaucguccuccucggcuucaucaugugggccugccagaagggcaacauccgcugcaacaucugcaucuga

SEQ ID NO: 92670 - RNA, 1701 nt, Artificial Sequence; identical to SEQ ID NO: 92028
  derived and/or modified sequence opt2 from hemagglutinin__InfluenzaA__ABG88652

SEQ ID NO: 92671 - RNA, 1701 nt, Artificial Sequence; identical to SEQ ID NO: 92028
  derived and/or modified sequence opt2 from hemagglutinin__InfluenzaA__ABG88663

SEQ ID NO: 92672 - RNA, 1701 nt, Artificial Sequence; identical to SEQ ID NO: 92028
  derived and/or modified sequence opt2 from hemagglutinin__InfluenzaA__ABG88674

SEQ ID NO: 92673 - RNA, 1701 nt, Artificial Sequence; identical to SEQ ID NO: 92028
  derived and/or modified sequence opt2 from hemagglutinin__InfluenzaA__ABG88685

SEQ ID NO: 92674 - RNA, 1701 nt, Artificial Sequence; identical to SEQ ID NO: 92028
  derived and/or modified sequence opt2 from hemagglutinin__InfluenzaA__ABG88696

SEQ ID NO: 92675 - RNA, 1701 nt, Artificial Sequence; identical to SEQ ID NO: 91794
  derived and/or modified sequence opt2 from hemagglutinin__InfluenzaA__ABG88707

SEQ ID NO: 92676 - RNA, 1701 nt, Artificial Sequence; identical to SEQ ID NO: 91794
  derived and/or modified sequence opt2 from hemagglutinin__InfluenzaA__ABG88718

SEQ ID NO: 92677 - RNA, 1701 nt, Artificial Sequence
  derived and/or modified sequence opt2 from hemagglutinin__InfluenzaA__ABG88729
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacuccggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92678 - RNA, 1701 nt, Artificial Sequence
  derived and/or modified sequence opt2 from hemagglutinin__InfluenzaA__ABG88740
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacaucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92679 - RNA, 1701 nt, Artificial Sequence; identical to SEQ ID NO: 92565
  derived and/or modified sequence opt2 from hemagglutinin__InfluenzaA__ABG88751

SEQ ID NO: 92680 - RNA, 1701 nt, Artificial Sequence
  derived and/or modified sequence opt2 from hemagglutinin__InfluenzaA__ABG88762
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgccuccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaggucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92681 - RNA, 1701 nt, Artificial Sequence
  derived and/or modified sequence opt2 from hemagglutinin__InfluenzaA__ABG88773
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccgccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaccgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92682 - RNA, 1701 nt, Artificial Sequence
  derived and/or modified sequence opt2 from hemagglutinin__InfluenzaA__ABG88784
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92683 - RNA, 1701 nt, Artificial Sequence
  derived and/or modified sequence opt2 from hemagglutinin__InfluenzaA__ABG88806
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccguccccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92684 - RNA, 1704 nt, Artificial Sequence
  derived and/or modified sequence opt2 from hemagglutinin__InfluenzaA__ABI16504
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucaucuccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacaacgccgccgagcagaccaagcucuaccagaaccccaccaccuacaucuccgucggcaccuccacccucaaccuccgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 92685 - RNA, 1701 nt, Artificial Sequence; identical to SEQ ID NO: 92145
  derived and/or modified sequence opt2 from hemagglutinin__InfluenzaA__ABI20793

SEQ ID NO: 92686 - RNA, 1701 nt, Artificial Sequence
  derived and/or modified sequence opt2 from hemagglutinin__InfluenzaA__ABI20837
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92687 - RNA, 1701 nt, Artificial Sequence
  derived and/or modified sequence opt2 from hemagglutinin__InfluenzaA__ABI20848
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcucaaggagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgcccacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92688 - RNA, 1701 nt, Artificial Sequence; identical to SEQ ID NO: 92433
  derived and/or modified sequence opt2 from hemagglutinin__InfluenzaA__ABI20859

SEQ ID NO: 92689 - RNA, 1701 nt, Artificial Sequence
  derived and/or modified sequence opt2 from hemagglutinin__InfluenzaA__ABI20870
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccgagugcgagucccucuucuccaaggaguccugguccuacaucgccgagacccccaaccccgagaacggcaccugcuaccccggcaacuucgccgacuacgaggagcuccgcgagcagcucuccuccgucuccuccuucgagcgcuucgagaucuuccccaaggaguccuccuggcccaaccacaccgucaccaagggcgucaccgucuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaugcgcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92690 - RNA, 1701 nt, Artificial Sequence; identical to SEQ ID NO: 92501
  derived and/or modified sequence opt2 from hemagglutinin__InfluenzaA__ABI20881

SEQ ID NO: 92691 - RNA, 1701 nt, Artificial Sequence
  derived and/or modified sequence opt2 from hemagglutinin__InfluenzaA__ABI20892
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaaggagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccauccacuggaccaucgucaagcccggcgacauccuccucaucaccuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92692 - RNA, 1701 nt, Artificial Sequence
  derived and/or modified sequence opt2 from hemagglutinin__InfluenzaA__ABI20903
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucauccacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92693 - RNA, 1701 nt, Artificial Sequence
  derived and/or modified sequence opt2 from hemagglutinin__InfluenzaA__ABI20914
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgucucccucggcuucaucaugugggccugccagaagggcaacauccgcugcaacaucugcaucuga

SEQ ID NO: 92694 - RNA, 1701 nt, Artificial Sequence; identical to SEQ ID NO: 92578
  derived and/or modified sequence opt2 from hemagglutinin__InfluenzaA__ABI20925

SEQ ID NO: 92695 - RNA, 1701 nt, Artificial Sequence; identical to SEQ ID NO: 92578
  derived and/or modified sequence opt2 from hemagglutinin__InfluenzaA__ABI20936

SEQ ID NO: 92696 - RNA, 1701 nt, Artificial Sequence
  derived and/or modified sequence opt2 from hemagglutinin__InfluenzaA__ABI20947
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagcaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92697 - RNA, 1701 nt, Artificial Sequence
  derived and/or modified sequence opt2 from hemagglutinin__InfluenzaA__ABI20958
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcucuacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92698 - RNA, 1701 nt, Artificial Sequence
  derived and/or modified sequence opt2 from hemagglutinin__InfluenzaA__ABI20969
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggaguggaaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92699 - RNA, 1701 nt, Artificial Sequence
  derived and/or modified sequence opt2 from hemagglutinin__InfluenzaA__ABI20980
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaccaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucacccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccucaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagauccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92700 - RNA, 1701 nt, Artificial Sequence
  derived and/or modified sequence opt2 from hemagglutinin__InfluenzaA__ABI20991
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaucaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92701 - RNA, 1701 nt, Artificial Sequence; identical to SEQ ID NO: 92222
  derived and/or modified sequence opt2 from hemagglutinin__InfluenzaA__ABI21002

SEQ ID NO: 92702 - RNA, 1701 nt, Artificial Sequence; identical to SEQ ID NO: 92666
  derived and/or modified sequence opt2 from hemagglutinin__InfluenzaA__ABI21013

SEQ ID NO: 92703 - RNA, 1701 nt, Artificial Sequence; identical to SEQ ID NO: 92152
  derived and/or modified sequence opt2 from hemagglutinin__InfluenzaA__ABI21024

SEQ ID NO: 92704 - RNA, 1701 nt, Artificial Sequence; identical to SEQ ID NO: 92028
  derived and/or modified sequence opt2 from hemagglutinin__InfluenzaA__ABI21035

SEQ ID NO: 92705 - RNA, 1701 nt, Artificial Sequence
  derived and/or modified sequence opt2 from hemagglutinin__InfluenzaA__ABI21046
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92706 - RNA, 1701 nt, Artificial Sequence
  derived and/or modified sequence opt2 from hemagglutinin__InfluenzaA__ABI21057
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92707 - RNA, 1701 nt, Artificial Sequence; identical to SEQ ID NO: 91755
  derived and/or modified sequence opt2 from hemagglutinin__InfluenzaA__ABI21068

SEQ ID NO: 92708 - RNA, 1701 nt, Artificial Sequence; identical to SEQ ID NO: 91794
  derived and/or modified sequence opt2 from hemagglutinin__InfluenzaA__ABI21079

SEQ ID NO: 92709 - RNA, 1701 nt, Artificial Sequence; identical to SEQ ID NO: 92625
  derived and/or modified sequence opt2 from hemagglutinin__InfluenzaA__ABI21090

SEQ ID NO: 92710 - RNA, 1701 nt, Artificial Sequence; identical to SEQ ID NO: 92625
  derived and/or modified sequence opt2 from hemagglutinin__InfluenzaA__ABI21101

SEQ ID NO: 92711 - RNA, 1701 nt, Artificial Sequence
  derived and/or modified sequence opt2 from hemagglutinin__InfluenzaA__ABI21123
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaagcacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92712 - RNA, 1701 nt, Artificial Sequence
  derived and/or modified sequence opt2 from hemagglutinin__InfluenzaA__ABI21134
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucauggacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcucccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92713 - RNA, 1701 nt, Artificial Sequence; identical to SEQ ID NO: 91794
  derived and/or modified sequence opt2 from hemagglutinin__InfluenzaA__ABI21156

SEQ ID NO: 92714 - RNA, 1701 nt, Artificial Sequence
  derived and/or modified sequence opt2 from hemagglutinin__InfluenzaA__ABI21167
augaagaccaucaucgcccucggcuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgaggucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92715 - RNA, 1701 nt, Artificial Sequence
  derived and/or modified sequence opt2 from hemagglutinin__InfluenzaA__ABI21178
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92716 - RNA, 1698 nt, Artificial Sequence
  derived and/or modified sequence opt2 from hemagglutinin__InfluenzaA__ABI21200
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92717 - RNA, 1698 nt, Artificial Sequence; identical to SEQ ID NO: 92716
  derived and/or modified sequence opt2 from hemagglutinin__InfluenzaA__ABI21211

SEQ ID NO: 92718 - RNA, 1698 nt, Artificial Sequence
  derived and/or modified sequence opt2 from hemagglutinin__InfluenzaA__ABI21233
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucaacuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92719 - RNA, 1701 nt, Artificial Sequence
  derived and/or modified sequence opt2 from hemagglutinin__InfluenzaA__ABI21244
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucaaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92720 - RNA, 1701 nt, Artificial Sequence; identical to SEQ ID NO: 92565
  derived and/or modified sequence opt2 from hemagglutinin__InfluenzaA__ABI21255

SEQ ID NO: 92721 - RNA, 1701 nt, Artificial Sequence; identical to SEQ ID NO: 92565
  derived and/or modified sequence opt2 from hemagglutinin__InfluenzaA__ABI21266

SEQ ID NO: 92722 - RNA, 1701 nt, Artificial Sequence; identical to SEQ ID NO: 92565
  derived and/or modified sequence opt2 from hemagglutinin__InfluenzaA__ABI21277

SEQ ID NO: 92723 - RNA, 1701 nt, Artificial Sequence
  derived and/or modified sequence opt2 from hemagglutinin__InfluenzaA__ABI21299
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92724 - RNA, 1701 nt, Artificial Sequence; identical to SEQ ID NO: 92565
  derived and/or modified sequence opt2 from hemagglutinin__InfluenzaA__ABI21310

SEQ ID NO: 92725 - RNA, 1701 nt, Artificial Sequence
  derived and/or modified sequence opt2 from hemagglutinin__InfluenzaA__ABI21321
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92726 - RNA, 1701 nt, Artificial Sequence
  derived and/or modified sequence opt2 from hemagglutinin__InfluenzaA__ABI21332
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92727 - RNA, 1701 nt, Artificial Sequence; identical to SEQ ID NO: 92565
  derived and/or modified sequence opt2 from hemagglutinin__InfluenzaA__ABI21343

SEQ ID NO: 92728 - RNA, 1701 nt, Artificial Sequence
  derived and/or modified sequence opt2 from hemagglutinin__InfluenzaA__ABI21354
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92729 - RNA, 1701 nt, Artificial Sequence
  derived and/or modified sequence opt2 from hemagglutinin__InfluenzaA__ABI21365
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauggacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92730 - RNA, 1701 nt, Artificial Sequence
  derived and/or modified sequence opt2 from hemagglutinin__InfluenzaA__ABI21376
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92731 - RNA, 1701 nt, Artificial Sequence; identical to SEQ ID NO: 92565
  derived and/or modified sequence opt2 from hemagglutinin__InfluenzaA__ABI21387

SEQ ID NO: 92732 - RNA, 1701 nt, Artificial Sequence
  derived and/or modified sequence opt2 from hemagglutinin__InfluenzaA__ABI21398
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucgucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92733 - RNA, 1701 nt, Artificial Sequence; identical to SEQ ID NO: 92565
  derived and/or modified sequence opt2 from hemagglutinin__InfluenzaA__ABI21409

SEQ ID NO: 92734 - RNA, 1701 nt, Artificial Sequence
  derived and/or modified sequence opt2 from hemagglutinin__InfluenzaA__ABI21420
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaguccgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92735 - RNA, 1701 nt, Artificial Sequence; identical to SEQ ID NO: 92565
  derived and/or modified sequence opt2 from hemagglutinin__InfluenzaA__ABI21431

SEQ ID NO: 92736 - RNA, 1701 nt, Artificial Sequence; identical to SEQ ID NO: 92565
  derived and/or modified sequence opt2 from hemagglutinin__InfluenzaA__ABI21442

SEQ ID NO: 92737 - RNA, 1701 nt, Artificial Sequence; identical to SEQ ID NO: 92565
  derived and/or modified sequence opt2 from hemagglutinin__InfluenzaA__ABI21453

SEQ ID NO: 92738 - RNA, 1701 nt, Artificial Sequence; identical to SEQ ID NO: 92565
  derived and/or modified sequence opt2 from hemagglutinin__InfluenzaA__ABI21464

SEQ ID NO: 92739 - RNA, 1701 nt, Artificial Sequence; identical to SEQ ID NO: 92565
  derived and/or modified sequence opt2 from hemagglutinin__InfluenzaA__ABI21475

SEQ ID NO: 92740 - RNA, 1701 nt, Artificial Sequence
  derived and/or modified sequence opt2 from hemagglutinin__InfluenzaA__ABI21486
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggaggccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92741 - RNA, 1701 nt, Artificial Sequence; identical to SEQ ID NO: 92565
  derived and/or modified sequence opt2 from hemagglutinin__InfluenzaA__ABI21497

SEQ ID NO: 92742 - RNA, 1698 nt, Artificial Sequence
  derived and/or modified sequence opt2 from hemagglutinin__InfluenzaA__ABI21530
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcguccagcgcgccaucuaccgcaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgcccccaugaacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92743 - RNA, 1698 nt, Artificial Sequence
  derived and/or modified sequence opt2 from hemagglutinin__InfluenzaA__ABI21552
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcguccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92744 - RNA, 1698 nt, Artificial Sequence
  derived and/or modified sequence opt2 from hemagglutinin__InfluenzaA__ABI21563
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcguccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgcccccaugaacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92745 - RNA, 1698 nt, Artificial Sequence; identical to SEQ ID NO: 92744
  derived and/or modified sequence opt2 from hemagglutinin__InfluenzaA__ABI21574

SEQ ID NO: 92746 - RNA, 1701 nt, Artificial Sequence
  derived and/or modified sequence opt2 from hemagglutinin__InfluenzaA__ABI21736
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacgucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92747 - RNA, 1701 nt, Artificial Sequence
  derived and/or modified sequence opt2 from hemagglutinin__InfluenzaA__ABI22159
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaacgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92748 - RNA, 1707 nt, Artificial Sequence
  derived and/or modified sequence opt2 from hemagglutinin__InfluenzaA__ABI23979
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggagucccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 92749 - RNA, 1701 nt, Artificial Sequence; identical to SEQ ID NO: 91794
  derived and/or modified sequence opt2 from hemagglutinin__InfluenzaA__ABI26646

SEQ ID NO: 92750 - RNA, 1701 nt, Artificial Sequence; identical to SEQ ID NO: 92423
  derived and/or modified sequence opt2 from hemagglutinin__InfluenzaA__ABI30367

SEQ ID NO: 92751 - RNA, 1701 nt, Artificial Sequence; identical to SEQ ID NO: 92433
  derived and/or modified sequence opt2 from hemagglutinin__InfluenzaA__ABI30378

SEQ ID NO: 92752 - RNA, 1701 nt, Artificial Sequence; identical to SEQ ID NO: 92162
  derived and/or modified sequence opt2 from hemagglutinin__InfluenzaA__ABI30400

SEQ ID NO: 92753 - RNA, 1701 nt, Artificial Sequence
  derived and/or modified sequence opt2 from hemagglutinin__InfluenzaA__ABI30411
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauggacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92754 - RNA, 1701 nt, Artificial Sequence; identical to SEQ ID NO: 92103
  derived and/or modified sequence opt2 from hemagglutinin__InfluenzaA__ABI30422

SEQ ID NO: 92755 - RNA, 1701 nt, Artificial Sequence; identical to SEQ ID NO: 91794
  derived and/or modified sequence opt2 from hemagglutinin__InfluenzaA__ABI30433

SEQ ID NO: 92756 - RNA, 1701 nt, Artificial Sequence; identical to SEQ ID NO: 92103
  derived and/or modified sequence opt2 from hemagglutinin__InfluenzaA__ABI30444

SEQ ID NO: 92757 - RNA, 1701 nt, Artificial Sequence; identical to SEQ ID NO: 91794
  derived and/or modified sequence opt2 from hemagglutinin__InfluenzaA__ABI30455

SEQ ID NO: 92758 - RNA, 1701 nt, Artificial Sequence; identical to SEQ ID NO: 91794
  derived and/or modified sequence opt2 from hemagglutinin__InfluenzaA__ABI30466

SEQ ID NO: 92759 - RNA, 1701 nt, Artificial Sequence; identical to SEQ ID NO: 91794
  derived and/or modified sequence opt2 from hemagglutinin__InfluenzaA__ABI30477

SEQ ID NO: 92760 - RNA, 1701 nt, Artificial Sequence; identical to SEQ ID NO: 91794
  derived and/or modified sequence opt2 from hemagglutinin__InfluenzaA__ABI30488

SEQ ID NO: 92761 - RNA, 1701 nt, Artificial Sequence; identical to SEQ ID NO: 91794
  derived and/or modified sequence opt2 from hemagglutinin__InfluenzaA__ABI30499

SEQ ID NO: 92762 - RNA, 1701 nt, Artificial Sequence; identical to SEQ ID NO: 91755
  derived and/or modified sequence opt2 from hemagglutinin__InfluenzaA__ABI30510

SEQ ID NO: 92763 - RNA, 1701 nt, Artificial Sequence
  derived and/or modified sequence opt2 from hemagglutinin__InfluenzaA__ABI30521
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92764 - RNA, 1701 nt, Artificial Sequence; identical to SEQ ID NO: 91794
  derived and/or modified sequence opt2 from hemagglutinin__InfluenzaA__ABI30532

SEQ ID NO: 92765 - RNA, 1701 nt, Artificial Sequence; identical to SEQ ID NO: 92625
  derived and/or modified sequence opt2 from hemagglutinin__InfluenzaA__ABI30543

SEQ ID NO: 92766 - RNA, 1701 nt, Artificial Sequence; identical to SEQ ID NO: 91794
  derived and/or modified sequence opt2 from hemagglutinin__InfluenzaA__ABI30554

SEQ ID NO: 92767 - RNA, 1698 nt, Artificial Sequence; identical to SEQ ID NO: 92716
  derived and/or modified sequence opt2 from hemagglutinin__InfluenzaA__ABI30565

SEQ ID NO: 92768 - RNA, 1701 nt, Artificial Sequence; identical to SEQ ID NO: 92145
  derived and/or modified sequence opt2 from hemagglutinin__InfluenzaA__ABI30587

SEQ ID NO: 92769 - RNA, 1701 nt, Artificial Sequence
  derived and/or modified sequence opt2 from hemagglutinin__InfluenzaA__ABI30609
augaagaccaucaucgcccucuccuacauccucugccucgucuucgcccagaagcuccccggcaacgacaacuccaccgccacccucugccucggccaccacgccguccccaacggcaccaucgucaagaccaucaugaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92770 - RNA, 1701 nt, Artificial Sequence
  derived and/or modified sequence opt2 from hemagglutinin__InfluenzaA__ABI30620
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92771 - RNA, 1701 nt, Artificial Sequence; identical to SEQ ID NO: 92145
  derived and/or modified sequence opt2 from hemagglutinin__InfluenzaA__ABI30733

SEQ ID NO: 92772 - RNA, 1701 nt, Artificial Sequence; identical to SEQ ID NO: 92145
  derived and/or modified sequence opt2 from hemagglutinin__InfluenzaA__ABI30744

SEQ ID NO: 92773 - RNA, 1701 nt, Artificial Sequence; identical to SEQ ID NO: 92145
  derived and/or modified sequence opt2 from hemagglutinin__InfluenzaA__ABI30755

SEQ ID NO: 92774 - RNA, 1701 nt, Artificial Sequence; identical to SEQ ID NO: 92145
  derived and/or modified sequence opt2 from hemagglutinin__InfluenzaA__ABI30766

SEQ ID NO: 92775 - RNA, 1701 nt, Artificial Sequence; identical to SEQ ID NO: 92145
  derived and/or modified sequence opt2 from hemagglutinin__InfluenzaA__ABI30777

SEQ ID NO: 92776 - RNA, 1701 nt, Artificial Sequence
  derived and/or modified sequence opt2 from hemagglutinin__InfluenzaA__ABI30788
augaagaccaucaucgcccucuccuacauccucugccucgucuucgcccagaagcucuccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92777 - RNA, 1701 nt, Artificial Sequence; identical to SEQ ID NO: 92145
  derived and/or modified sequence opt2 from hemagglutinin__InfluenzaA__ABI30799

SEQ ID NO: 92778 - RNA, 1701 nt, Artificial Sequence
  derived and/or modified sequence opt2 from hemagglutinin__InfluenzaA__ABI30810
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccaucaagaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92779 - RNA, 1701 nt, Artificial Sequence
  derived and/or modified sequence opt2 from hemagglutinin__InfluenzaA__ABI30821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucgccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92780 - RNA, 1701 nt, Artificial Sequence; identical to SEQ ID NO: 92145
  derived and/or modified sequence opt2 from hemagglutinin__InfluenzaA__ABI30832

SEQ ID NO: 92781 - RNA, 1701 nt, Artificial Sequence
  derived and/or modified sequence opt2 from hemagglutinin__InfluenzaA__ABI30843
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92782 - RNA, 1701 nt, Artificial Sequence; identical to SEQ ID NO: 92725
  derived and/or modified sequence opt2 from hemagglutinin__InfluenzaA__ABI30865

SEQ ID NO: 92783 - RNA, 1707 nt, Artificial Sequence
  derived and/or modified sequence opt2 from hemagglutinin__InfluenzaA__ABI36155
auggagaagaucguccuccuccucgccaccgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacggccucugcuaccccggcaacuucaacgacuacgaggagcucaagcaccuccucucccgcaucaaccacuucgagaagcuccagaucauccccaaguccuccugguccgaccacgaggccucccucggcgucuccuccgccugccccuaccucggccgcuccuccuucuuccgcaacgucgucuggcucaucaagaagaacaacaccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcgacugcaacaccaagugccagacccccaugggcgccaucaacuccuccaugccccuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaucuaccagauccucuccaucuacuccaccgucgccuccucccucgcccucgccaucaugauggccggccucucccucuggaugugcuccaacggcucccuccagugccgcgucugcaucuga

SEQ ID NO: 92784 - RNA, 1707 nt, Artificial Sequence
  derived and/or modified sequence opt2 from hemagglutinin__InfluenzaA__ABI36166
auggagaagaucguccuccuccucgccaccgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacggccucugcuaccccggcaacuucaacgacuacgaggagcucaagcaccuccucucccgcaucaaccacuucgagaagcuccagaucauccccaaguccuccugguccgaccacgaggccucccucggcgucuccuccgccugccccuaccucggccgcuccuccuucuuccgcaacgucgucuggcucaucaagaagaacaacaccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcgacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaucuaccagauccucuccaucuacuccaccgucgccuccucccucgcccucgccaucaugauggccggccucucccucuggaugugcuccaacggcucccuccagugccgcgucugcaucuga

SEQ ID NO: 92785 - RNA, 1707 nt, Artificial Sequence; identical to SEQ ID NO: 92784
  derived and/or modified sequence opt2 from hemagglutinin__InfluenzaA__ABI36177

SEQ ID NO: 92786 - RNA, 1707 nt, Artificial Sequence
  derived and/or modified sequence opt2 from hemagglutinin__InfluenzaA__ABI36406
auggagaagaucguccuccuccucgccaccgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacggccucugcuaccccggcaacuucaacgacuacgaggagcucaagcaccuccucucccgcaucaaccacuucgagaagcuccagaucauccccaaguccuccugguccgaccacgaggccucccucggcgucuccuccgccugccccuaccucggccgcuccuccuucuuccgcaacgucgucuggcucaucaagaagaacaacaccuaccccaccaucaagcgcuccuacaacaacaccaaccaggaggaccuccucguccucuggggccuccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcgacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaucuaccagauccucuccaucuacuccaccgucgccuccucccucgcccucgccaucaugauggccggccucucccucuggaugugcuccaacggcucccuccagugccgcgucugcaucuga

SEQ ID NO: 92787 - RNA, 1707 nt, Artificial Sequence
  derived and/or modified sequence opt2 from hemagglutinin__InfluenzaA__ABI36450
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucggcaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaccuccuacaacaacaccaaccaggaggaccuccucguccucuggggcauccaccacuccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92788 - RNA, 1707 nt, Artificial Sequence
  derived and/or modified sequence opt2 from hemagglutinin__InfluenzaA__ABI49396
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucggcaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucugggccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92789 - RNA, 1704 nt, Artificial Sequence
  derived and/or modified sequence opt2 from hemagglutinin__InfluenzaA__ABI85000
augaacacccagauccucgccuucaucgccugcaugcucaucggcaccaagggcgacaagaucugccucggccaccacgccgucgccaacggcaccaaggucaacacccucaccgagcgcggcaucgaggucgucaacgccaccgagaccgucgagaccgucaacaucaagaagaucugcacccagggcaagcgccccaccgaccucggccagugcggccuccucggcacccucaucggccccccccagugcgaccaguuccucgaguucgacgccaaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgccaccuccgccugccgccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcgagucccucggcguccaguccgacgucccccucgacuccggcugcgagggcgacugcuuccacuccggcggcaccaucgucuccucccuccccuuccagaacaucaacccccgcaccgucggcaagugcccccgcuacgucaagcagaccucccuccuccucgccaccggcaugcgcaacguccccgagaaccccaagcaggccuaccagaagcgcaugacccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgacaagaccaaccagcaguucgagcucaucgacaacgaguucuccgagaucgagcagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgaccagugcauggaguccauccgcaacaacaccuacgaccacacccaguaccgcaccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcgcugcaccaucugcaucuga

SEQ ID NO: 92790 - RNA, 1701 nt, Artificial Sequence; identical to SEQ ID NO: 92342
  derived and/or modified sequence opt2 from hemagglutinin__InfluenzaA__ABI92291

SEQ ID NO: 92791 - RNA, 1701 nt, Artificial Sequence
  derived and/or modified sequence opt2 from hemagglutinin__InfluenzaA__ABI92302
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92792 - RNA, 1701 nt, Artificial Sequence
  derived and/or modified sequence opt2 from hemagglutinin__InfluenzaA__ABI92313
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccaucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccacauccucgccaucuacuccaccgucgccuccucccucguccuccucgucucccucggcgccaucuccuucuggaugugcuccaacggcucccuccagugccgcaucugcaucuga

SEQ ID NO: 92793 - RNA, 1701 nt, Artificial Sequence
  derived and/or modified sequence opt2 from hemagglutinin__InfluenzaA__ABI92324
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92794 - RNA, 1701 nt, Artificial Sequence
  derived and/or modified sequence opt2 from hemagglutinin__InfluenzaA__ABI92335
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccucccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccucaugggcuucaucaugugggccugccagaagggcaacauccgcugcaacaucugcaucuga

SEQ ID NO: 92795 - RNA, 1701 nt, Artificial Sequence
  derived and/or modified sequence opt2 from hemagglutinin__InfluenzaA__ABI92346
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccacaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 92796 - RNA, 1701 nt, Artificial Sequence; identical to SEQ ID NO: 91794
  derived and/or modified sequence opt2 from hemagglutinin__InfluenzaA__ABI92357

SEQ ID NO: 92797 - RNA, 1701 nt, Artificial Sequence; identical to SEQ ID NO: 91794
  derived and/or modified sequence opt2 from hemagglutinin__InfluenzaA__ABI92368

SEQ ID NO: 92798 - RNA, 1698 nt, Artificial Sequence; identical to SEQ ID NO: 92716
  derived and/or modified sequence opt2 from hemagglutinin__InfluenzaA__ABI92379

SEQ ID NO: 92799 - RNA, 1701 nt, Artificial Sequence
  derived and/or modified sequence opt2 from hemagglutinin__InfluenzaA__ABI92390
augaagaccaucaucgccuucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaccucccucuacgcccaggccuccggccgcaucaccgucuccaccaagcgcucccagcagaccgucacccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92800 - RNA, 1701 nt, Artificial Sequence; identical to SEQ ID NO: 91794
  derived and/or modified sequence opt2 from hemagglutinin__InfluenzaA__ABI92401

SEQ ID NO: 92801 - RNA, 1701 nt, Artificial Sequence
  derived and/or modified sequence opt2 from hemagglutinin__InfluenzaA__ABI92412
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacaucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92802 - RNA, 1701 nt, Artificial Sequence
  derived and/or modified sequence opt2 from hemagglutinin__InfluenzaA__ABI92423
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgacaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92803 - RNA, 1701 nt, Artificial Sequence; identical to SEQ ID NO: 92145
  derived and/or modified sequence opt2 from hemagglutinin__InfluenzaA__ABI92434

SEQ ID NO: 92804 - RNA, 1701 nt, Artificial Sequence
  derived and/or modified sequence opt2 from hemagglutinin__InfluenzaA__ABI92445
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucaaccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92805 - RNA, 1701 nt, Artificial Sequence; identical to SEQ ID NO: 92145
  derived and/or modified sequence opt2 from hemagglutinin__InfluenzaA__ABI92456

SEQ ID NO: 92806 - RNA, 1701 nt, Artificial Sequence; identical to SEQ ID NO: 92753
  derived and/or modified sequence opt2 from hemagglutinin__InfluenzaA__ABI92467

SEQ ID NO: 92807 - RNA, 1701 nt, Artificial Sequence; identical to SEQ ID NO: 92162
  derived and/or modified sequence opt2 from hemagglutinin__InfluenzaA__ABI92478

SEQ ID NO: 92808 - RNA, 1701 nt, Artificial Sequence; identical to SEQ ID NO: 92753
  derived and/or modified sequence opt2 from hemagglutinin__InfluenzaA__ABI92489

SEQ ID NO: 92809 - RNA, 1701 nt, Artificial Sequence
  derived and/or modified sequence opt2 from hemagglutinin__InfluenzaA__ABI92500
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgucaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92810 - RNA, 1701 nt, Artificial Sequence
  derived and/or modified sequence opt2 from hemagglutinin__InfluenzaA__ABI92511
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccagaacuccuccaccggcaucaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaccgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92811 - RNA, 1701 nt, Artificial Sequence
  derived and/or modified sequence opt2 from hemagglutinin__InfluenzaA__ABI92522
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92812 - RNA, 1701 nt, Artificial Sequence
  derived and/or modified sequence opt2 from hemagglutinin__InfluenzaA__ABI92533
augaagaccaucaucgcccucuccuacauccucugccucgucuucgcccagaagcuccccggcaacgacaacucccgcgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92813 - RNA, 1701 nt, Artificial Sequence; identical to SEQ ID NO: 92812
  derived and/or modified sequence opt2 from hemagglutinin__InfluenzaA__ABI92544

SEQ ID NO: 92814 - RNA, 1701 nt, Artificial Sequence
  derived and/or modified sequence opt2 from hemagglutinin__InfluenzaA__ABI92577
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92815 - RNA, 1701 nt, Artificial Sequence; identical to SEQ ID NO: 92551
  derived and/or modified sequence opt2 from hemagglutinin__InfluenzaA__ABI92588

SEQ ID NO: 92816 - RNA, 1701 nt, Artificial Sequence
  derived and/or modified sequence opt2 from hemagglutinin__InfluenzaA__ABI92599
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92817 - RNA, 1701 nt, Artificial Sequence
  derived and/or modified sequence opt2 from hemagglutinin__InfluenzaA__ABI92610
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92818 - RNA, 1701 nt, Artificial Sequence
  derived and/or modified sequence opt2 from hemagglutinin__InfluenzaA__ABI92621
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgagggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggccucugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92819 - RNA, 1701 nt, Artificial Sequence; identical to SEQ ID NO: 92074
  derived and/or modified sequence opt2 from hemagglutinin__InfluenzaA__ABI92632

SEQ ID NO: 92820 - RNA, 1701 nt, Artificial Sequence
  derived and/or modified sequence opt2 from hemagglutinin__InfluenzaA__ABI92643
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccauccccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92821 - RNA, 1701 nt, Artificial Sequence
  derived and/or modified sequence opt2 from hemagglutinin__InfluenzaA__ABI92665
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgcggcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcaacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92822 - RNA, 1701 nt, Artificial Sequence
  derived and/or modified sequence opt2 from hemagglutinin__InfluenzaA__ABI92676
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92823 - RNA, 1701 nt, Artificial Sequence
  derived and/or modified sequence opt2 from hemagglutinin__InfluenzaA__ABI92687
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgcggcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92824 - RNA, 1701 nt, Artificial Sequence; identical to SEQ ID NO: 92823
  derived and/or modified sequence opt2 from hemagglutinin__InfluenzaA__ABI92698

SEQ ID NO: 92825 - RNA, 1701 nt, Artificial Sequence; identical to SEQ ID NO: 92028
  derived and/or modified sequence opt2 from hemagglutinin__InfluenzaA__ABI92709

SEQ ID NO: 92826 - RNA, 1701 nt, Artificial Sequence
  derived and/or modified sequence opt2 from hemagglutinin__InfluenzaA__ABI92720
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgaguccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92827 - RNA, 1701 nt, Artificial Sequence
  derived and/or modified sequence opt2 from hemagglutinin__InfluenzaA__ABI92731
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92828 - RNA, 1701 nt, Artificial Sequence
  derived and/or modified sequence opt2 from hemagglutinin__InfluenzaA__ABI92742
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92829 - RNA, 1701 nt, Artificial Sequence
  derived and/or modified sequence opt2 from hemagglutinin__InfluenzaA__ABI92753
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccuaccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92830 - RNA, 1701 nt, Artificial Sequence
  derived and/or modified sequence opt2 from hemagglutinin__InfluenzaA__ABI92764
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgcggcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagcgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92831 - RNA, 1701 nt, Artificial Sequence; identical to SEQ ID NO: 92823
  derived and/or modified sequence opt2 from hemagglutinin__InfluenzaA__ABI92775

SEQ ID NO: 92832 - RNA, 1701 nt, Artificial Sequence; identical to SEQ ID NO: 91755
  derived and/or modified sequence opt2 from hemagglutinin__InfluenzaA__ABI92786

SEQ ID NO: 92833 - RNA, 1701 nt, Artificial Sequence
  derived and/or modified sequence opt2 from hemagglutinin__InfluenzaA__ABI92797
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucaucuccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92834 - RNA, 1701 nt, Artificial Sequence; identical to SEQ ID NO: 91755
  derived and/or modified sequence opt2 from hemagglutinin__InfluenzaA__ABI92808

SEQ ID NO: 92835 - RNA, 1701 nt, Artificial Sequence; identical to SEQ ID NO: 91755
  derived and/or modified sequence opt2 from hemagglutinin__InfluenzaA__ABI92819

SEQ ID NO: 92836 - RNA, 1701 nt, Artificial Sequence; identical to SEQ ID NO: 91755
  derived and/or modified sequence opt2 from hemagglutinin__InfluenzaA__ABI92841

SEQ ID NO: 92837 - RNA, 1701 nt, Artificial Sequence
  derived and/or modified sequence opt2 from hemagglutinin__InfluenzaA__ABI92852
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcuaccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92838 - RNA, 1701 nt, Artificial Sequence
  derived and/or modified sequence opt2 from hemagglutinin__InfluenzaA__ABI92863
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaaccaguccuucuucucccgccucaacuggcucacccaccucaaguucaaguaccccgcccucaacgucaccaugcccaacaacgagaaguucgacaagcucuacaucuggggcguccaccaccccggcaccgacuccgaccagaucucccucuacgcccaggcccccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggccgcugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 92839 - RNA, 1701 nt, Artificial Sequence; identical to SEQ ID NO: 91755
  derived and/or modified sequence opt2 from hemagglutinin__InfluenzaA__ABI92874

SEQ ID NO: 92840 - RNA, 1701 nt, Artificial Sequence; identical to SEQ ID NO: 91755
  derived and/or modified sequence opt2 from hemagglutinin__InfluenzaA__ABI92885

SEQ ID NO: 92841 - RNA, 1701 nt, Artificial Sequence
  derived and/or modified sequence opt2 from hemagglutinin__InfluenzaA__ABI92907
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacucccccuaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92842 - RNA, 1701 nt, Artificial Sequence; identical to SEQ ID NO: 91755
  derived and/or modified sequence opt2 from hemagglutinin__InfluenzaA__ABI92918

SEQ ID NO: 92843 - RNA, 1701 nt, Artificial Sequence; identical to SEQ ID NO: 92841
  derived and/or modified sequence opt2 from hemagglutinin__InfluenzaA__ABI92929

SEQ ID NO: 92844 - RNA, 1701 nt, Artificial Sequence
  derived and/or modified sequence opt2 from hemagglutinin__InfluenzaA__ABI92940
augaagaccaucaucgccuucaacuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaucuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92845 - RNA, 1701 nt, Artificial Sequence
  derived and/or modified sequence opt2 from hemagglutinin__InfluenzaA__ABI92951
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacuccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92846 - RNA, 1701 nt, Artificial Sequence
  derived and/or modified sequence opt2 from hemagglutinin__InfluenzaA__ABI92962
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92847 - RNA, 1701 nt, Artificial Sequence; identical to SEQ ID NO: 92145
  derived and/or modified sequence opt2 from hemagglutinin__InfluenzaA__ABI92973

SEQ ID NO: 92848 - RNA, 1701 nt, Artificial Sequence; identical to SEQ ID NO: 92145
  derived and/or modified sequence opt2 from hemagglutinin__InfluenzaA__ABI92984

SEQ ID NO: 92849 - RNA, 1701 nt, Artificial Sequence
  derived and/or modified sequence opt2 from hemagglutinin__InfluenzaA__ABI92995
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92850 - RNA, 1701 nt, Artificial Sequence; identical to SEQ ID NO: 92145
  derived and/or modified sequence opt2 from hemagglutinin__InfluenzaA__ABI93006

SEQ ID NO: 92851 - RNA, 1701 nt, Artificial Sequence; identical to SEQ ID NO: 92145
  derived and/or modified sequence opt2 from hemagglutinin__InfluenzaA__ABI93017

SEQ ID NO: 92852 - RNA, 1698 nt, Artificial Sequence; identical to SEQ ID NO: 92744
  derived and/or modified sequence opt2 from hemagglutinin__InfluenzaA__ABI93028

SEQ ID NO: 92853 - RNA, 1701 nt, Artificial Sequence; identical to SEQ ID NO: 92478
  derived and/or modified sequence opt2 from hemagglutinin__InfluenzaA__ABI93039

SEQ ID NO: 92854 - RNA, 1701 nt, Artificial Sequence
  derived and/or modified sequence opt2 from hemagglutinin__InfluenzaA__ABI93061
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92855 - RNA, 1701 nt, Artificial Sequence; identical to SEQ ID NO: 92162
  derived and/or modified sequence opt2 from hemagglutinin__InfluenzaA__ABI93072

SEQ ID NO: 92856 - RNA, 1701 nt, Artificial Sequence; identical to SEQ ID NO: 92162
  derived and/or modified sequence opt2 from hemagglutinin__InfluenzaA__ABI93083

SEQ ID NO: 92857 - RNA, 1701 nt, Artificial Sequence; identical to SEQ ID NO: 92162
  derived and/or modified sequence opt2 from hemagglutinin__InfluenzaA__ABI93094

SEQ ID NO: 92858 - RNA, 1701 nt, Artificial Sequence; identical to SEQ ID NO: 92162
  derived and/or modified sequence opt2 from hemagglutinin__InfluenzaA__ABI93105

SEQ ID NO: 92859 - RNA, 1701 nt, Artificial Sequence
  derived and/or modified sequence opt2 from hemagglutinin__InfluenzaA__ABI93116
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagaugcgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacggcgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92860 - RNA, 1689 nt, Artificial Sequence
  derived and/or modified sequence opt2 from hemagglutinin__InfluenzaA__ABI94581
augaacacccagauccucgucuucgcccucgucgccuccauccccaccaacgccgacaagaucugccucggccaccacgccgucuccaacggcaccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcaccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucauccucaaccccaacgacaccgucaccuucuccuucaacggcgccuucaucgcccccgaccgcgccuccuuccuccgcggcaaguccaugggcauccaguccgagguccaggucgacgccaacugcgagggcgacugcuaccacuccggcggcaccaucaucuccaaccuccccuuccagaacaucaacucccgcgccgucggcaagugcccccgcuacgucaagcaggagucccuccuccucgccaccggcaugaagaacguccccgagauccccaagcgccgccgccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccauccagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 92861 - RNA, 1701 nt, Artificial Sequence; identical to SEQ ID NO: 92278
  derived and/or modified sequence opt2 from hemagglutinin__InfluenzaA__ABI95228

SEQ ID NO: 92862 - RNA, 1701 nt, Artificial Sequence
  derived and/or modified sequence opt2 from hemagglutinin__InfluenzaA__ABI95239
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucaacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92863 - RNA, 1698 nt, Artificial Sequence
  derived and/or modified sequence opt2 from hemagglutinin__InfluenzaA__ABI95250
augaaggccaagcuccucguccuccucugcaccuucaccgccaccuacgccgacaccaucugcgucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugaacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92864 - RNA, 1698 nt, Artificial Sequence
  derived and/or modified sequence opt2 from hemagglutinin__InfluenzaA__ABI95261
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcguccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgcccccaugaacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92865 - RNA, 1698 nt, Artificial Sequence; identical to SEQ ID NO: 92744
  derived and/or modified sequence opt2 from hemagglutinin__InfluenzaA__ABI95272

SEQ ID NO: 92866 - RNA, 1698 nt, Artificial Sequence; identical to SEQ ID NO: 92744
  derived and/or modified sequence opt2 from hemagglutinin__InfluenzaA__ABI95283

SEQ ID NO: 92867 - RNA, 1698 nt, Artificial Sequence; identical to SEQ ID NO: 91808
  derived and/or modified sequence opt2 from hemagglutinin__InfluenzaA__ABI95294

SEQ ID NO: 92868 - RNA, 1698 nt, Artificial Sequence
  derived and/or modified sequence opt2 from hemagglutinin__InfluenzaA__ABI96104
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucaucaaguccuacgccaacaacaaggagaaggagguccucauccucuggggcguccaccacccccccaacaucggcgaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92869 - RNA, 1701 nt, Artificial Sequence; identical to SEQ ID NO: 92162
  derived and/or modified sequence opt2 from hemagglutinin__InfluenzaA__ABJ09107

SEQ ID NO: 92870 - RNA, 1701 nt, Artificial Sequence
  derived and/or modified sequence opt2 from hemagglutinin__InfluenzaA__ABJ09140
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccggccuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92871 - RNA, 1698 nt, Artificial Sequence
  derived and/or modified sequence opt2 from hemagglutinin__InfluenzaA__ABJ09151
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaagggcaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92872 - RNA, 1701 nt, Artificial Sequence
  derived and/or modified sequence opt2 from hemagglutinin__InfluenzaA__ABJ09162
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccaacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagauccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92873 - RNA, 1701 nt, Artificial Sequence; identical to SEQ ID NO: 91755
  derived and/or modified sequence opt2 from hemagglutinin__InfluenzaA__ABJ09173

SEQ ID NO: 92874 - RNA, 1698 nt, Artificial Sequence
  derived and/or modified sequence opt2 from hemagglutinin__InfluenzaA__ABJ09184
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgaggccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92875 - RNA, 1701 nt, Artificial Sequence; identical to SEQ ID NO: 92145
  derived and/or modified sequence opt2 from hemagglutinin__InfluenzaA__ABJ09195

SEQ ID NO: 92876 - RNA, 1701 nt, Artificial Sequence; identical to SEQ ID NO: 92145
  derived and/or modified sequence opt2 from hemagglutinin__InfluenzaA__ABJ09206

SEQ ID NO: 92877 - RNA, 1701 nt, Artificial Sequence; identical to SEQ ID NO: 92725
  derived and/or modified sequence opt2 from hemagglutinin__InfluenzaA__ABJ09217

SEQ ID NO: 92878 - RNA, 1701 nt, Artificial Sequence; identical to SEQ ID NO: 92162
  derived and/or modified sequence opt2 from hemagglutinin__InfluenzaA__ABJ09228

SEQ ID NO: 92879 - RNA, 1701 nt, Artificial Sequence
  derived and/or modified sequence opt2 from hemagglutinin__InfluenzaA__ABJ09239
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcaccauggaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92880 - RNA, 1701 nt, Artificial Sequence
  derived and/or modified sequence opt2 from hemagglutinin__InfluenzaA__ABJ09250
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcauccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92881 - RNA, 1701 nt, Artificial Sequence
  derived and/or modified sequence opt2 from hemagglutinin__InfluenzaA__ABJ09261
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguaccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92882 - RNA, 1701 nt, Artificial Sequence
  derived and/or modified sequence opt2 from hemagglutinin__InfluenzaA__ABJ09272
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgccgcaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaggacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92883 - RNA, 1701 nt, Artificial Sequence; identical to SEQ ID NO: 91584
  derived and/or modified sequence opt2 from hemagglutinin__InfluenzaA__ABJ09294

SEQ ID NO: 92884 - RNA, 1701 nt, Artificial Sequence
  derived and/or modified sequence opt2 from hemagglutinin__InfluenzaA__ABJ09305
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92885 - RNA, 1701 nt, Artificial Sequence
  derived and/or modified sequence opt2 from hemagglutinin__InfluenzaA__ABJ09316
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccacuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92886 - RNA, 1701 nt, Artificial Sequence; identical to SEQ ID NO: 92162
  derived and/or modified sequence opt2 from hemagglutinin__InfluenzaA__ABJ09338

SEQ ID NO: 92887 - RNA, 1701 nt, Artificial Sequence
  derived and/or modified sequence opt2 from hemagglutinin__InfluenzaA__ABJ09349
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucauccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92888 - RNA, 1701 nt, Artificial Sequence; identical to SEQ ID NO: 92162
  derived and/or modified sequence opt2 from hemagglutinin__InfluenzaA__ABJ09360

SEQ ID NO: 92889 - RNA, 1701 nt, Artificial Sequence
  derived and/or modified sequence opt2 from hemagglutinin__InfluenzaA__ABJ09371
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgccuccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92890 - RNA, 1701 nt, Artificial Sequence; identical to SEQ ID NO: 92145
  derived and/or modified sequence opt2 from hemagglutinin__InfluenzaA__ABJ09382

SEQ ID NO: 92891 - RNA, 1701 nt, Artificial Sequence
  derived and/or modified sequence opt2 from hemagglutinin__InfluenzaA__ABJ16587
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92892 - RNA, 1701 nt, Artificial Sequence
  derived and/or modified sequence opt2 from hemagglutinin__InfluenzaA__ABJ16598
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92893 - RNA, 1701 nt, Artificial Sequence
  derived and/or modified sequence opt2 from hemagglutinin__InfluenzaA__ABJ16620
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacaagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92894 - RNA, 1701 nt, Artificial Sequence
  derived and/or modified sequence opt2 from hemagglutinin__InfluenzaA__ABJ16631
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92895 - RNA, 1698 nt, Artificial Sequence
  derived and/or modified sequence opt2 from hemagglutinin__InfluenzaA__ABJ16664
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92896 - RNA, 1698 nt, Artificial Sequence; identical to SEQ ID NO: 92716
  derived and/or modified sequence opt2 from hemagglutinin__InfluenzaA__ABJ16675

SEQ ID NO: 92897 - RNA, 1698 nt, Artificial Sequence
  derived and/or modified sequence opt2 from hemagglutinin__InfluenzaA__ABJ16686
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92898 - RNA, 1701 nt, Artificial Sequence
  derived and/or modified sequence opt2 from hemagglutinin__InfluenzaA__ABJ16697
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgccguccuccucggcuucaucaugugggccugccagaagggcaacauccgcugcaacaucugcaucuga

SEQ ID NO: 92899 - RNA, 1701 nt, Artificial Sequence
  derived and/or modified sequence opt2 from hemagglutinin__InfluenzaA__ABJ16730
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgcccgccgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92900 - RNA, 1701 nt, Artificial Sequence
  derived and/or modified sequence opt2 from hemagglutinin__InfluenzaA__ABJ16741
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaagggcuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92901 - RNA, 1701 nt, Artificial Sequence
  derived and/or modified sequence opt2 from hemagglutinin__InfluenzaA__ABJ16752
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92902 - RNA, 1701 nt, Artificial Sequence
  derived and/or modified sequence opt2 from hemagglutinin__InfluenzaA__ABJ16763
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccacuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92903 - RNA, 1701 nt, Artificial Sequence
  derived and/or modified sequence opt2 from hemagglutinin__InfluenzaA__ABJ16774
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccucccccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcaacggcaaguccuccaucaugcgcuccaacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92904 - RNA, 1701 nt, Artificial Sequence
  derived and/or modified sequence opt2 from hemagglutinin__InfluenzaA__ABJ16785
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92905 - RNA, 1701 nt, Artificial Sequence; identical to SEQ ID NO: 92422
  derived and/or modified sequence opt2 from hemagglutinin__InfluenzaA__ABJ53438

SEQ ID NO: 92906 - RNA, 1698 nt, Artificial Sequence; identical to SEQ ID NO: 92254
  derived and/or modified sequence opt2 from hemagglutinin__InfluenzaA__ABJ53449

SEQ ID NO: 92907 - RNA, 1701 nt, Artificial Sequence
  derived and/or modified sequence opt2 from hemagglutinin__InfluenzaA__ABJ53471
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92908 - RNA, 1701 nt, Artificial Sequence
  derived and/or modified sequence opt2 from hemagglutinin__InfluenzaA__ABJ53482
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92909 - RNA, 1698 nt, Artificial Sequence; identical to SEQ ID NO: 92744
  derived and/or modified sequence opt2 from hemagglutinin__InfluenzaA__ABJ53493

SEQ ID NO: 92910 - RNA, 1698 nt, Artificial Sequence
  derived and/or modified sequence opt2 from hemagglutinin__InfluenzaA__ABJ53504
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaucggcguccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgcccccaugaacgagugcgacgccaagugccagaccccccucggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92911 - RNA, 1701 nt, Artificial Sequence; identical to SEQ ID NO: 92899
  derived and/or modified sequence opt2 from hemagglutinin__InfluenzaA__ABJ53515

SEQ ID NO: 92912 - RNA, 1701 nt, Artificial Sequence
  derived and/or modified sequence opt2 from hemagglutinin__InfluenzaA__ABK39962
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92913 - RNA, 1701 nt, Artificial Sequence; identical to SEQ ID NO: 92142
  derived and/or modified sequence opt2 from hemagglutinin__InfluenzaA__ABK39973

SEQ ID NO: 92914 - RNA, 1701 nt, Artificial Sequence
  derived and/or modified sequence opt2 from hemagglutinin__InfluenzaA__ABK39984
augaagaccaucaucgcccucuccuacauccucugccucgucuucgcccagaagcuccccggcaacgacaacucccgcgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92915 - RNA, 1698 nt, Artificial Sequence
  derived and/or modified sequence opt2 from hemagglutinin__InfluenzaA__ABK39995
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcgccugcuaccccggcuacuucgccgacuacgaggagcuccgcgagcagcucuccuccgucuacuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcaaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgacuccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92916 - RNA, 1701 nt, Artificial Sequence
  derived and/or modified sequence opt2 from hemagglutinin__InfluenzaA__ABK40017
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacaagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92917 - RNA, 1701 nt, Artificial Sequence
  derived and/or modified sequence opt2 from hemagglutinin__InfluenzaA__ABK40028
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucaccguccucuccucccacuacucccgccgcuucacccccgagaucgcccgccgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92918 - RNA, 1701 nt, Artificial Sequence; identical to SEQ ID NO: 92899
  derived and/or modified sequence opt2 from hemagglutinin__InfluenzaA__ABK40039

SEQ ID NO: 92919 - RNA, 1701 nt, Artificial Sequence; identical to SEQ ID NO: 92899
  derived and/or modified sequence opt2 from hemagglutinin__InfluenzaA__ABK40050

SEQ ID NO: 92920 - RNA, 1701 nt, Artificial Sequence; identical to SEQ ID NO: 92162
  derived and/or modified sequence opt2 from hemagglutinin__InfluenzaA__ABK40061

SEQ ID NO: 92921 - RNA, 1701 nt, Artificial Sequence; identical to SEQ ID NO: 92162
  derived and/or modified sequence opt2 from hemagglutinin__InfluenzaA__ABK40075

SEQ ID NO: 92922 - RNA, 1701 nt, Artificial Sequence; identical to SEQ ID NO: 92433
  derived and/or modified sequence opt2 from hemagglutinin__InfluenzaA__ABK40510

SEQ ID NO: 92923 - RNA, 1701 nt, Artificial Sequence; identical to SEQ ID NO: 92433
  derived and/or modified sequence opt2 from hemagglutinin__InfluenzaA__ABK40534

SEQ ID NO: 92924 - RNA, 1701 nt, Artificial Sequence
  derived and/or modified sequence opt2 from hemagglutinin__InfluenzaA__ABK40546
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaacaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92925 - RNA, 1701 nt, Artificial Sequence; identical to SEQ ID NO: 92433
  derived and/or modified sequence opt2 from hemagglutinin__InfluenzaA__ABK40557

SEQ ID NO: 92926 - RNA, 1701 nt, Artificial Sequence; identical to SEQ ID NO: 92433
  derived and/or modified sequence opt2 from hemagglutinin__InfluenzaA__ABK40568

SEQ ID NO: 92927 - RNA, 1701 nt, Artificial Sequence; identical to SEQ ID NO: 92433
  derived and/or modified sequence opt2 from hemagglutinin__InfluenzaA__ABK40579

SEQ ID NO: 92928 - RNA, 1701 nt, Artificial Sequence
  derived and/or modified sequence opt2 from hemagglutinin__InfluenzaA__ABK40590
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92929 - RNA, 1701 nt, Artificial Sequence; identical to SEQ ID NO: 92433
  derived and/or modified sequence opt2 from hemagglutinin__InfluenzaA__ABK40601

SEQ ID NO: 92930 - RNA, 1701 nt, Artificial Sequence; identical to SEQ ID NO: 92162
  derived and/or modified sequence opt2 from hemagglutinin__InfluenzaA__ABK40612

SEQ ID NO: 92931 - RNA, 1701 nt, Artificial Sequence
  derived and/or modified sequence opt2 from hemagglutinin__InfluenzaA__ABK40623
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucgccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucaaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacgucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92932 - RNA, 1701 nt, Artificial Sequence; identical to SEQ ID NO: 92496
  derived and/or modified sequence opt2 from hemagglutinin__InfluenzaA__ABK40645

SEQ ID NO: 92933 - RNA, 1701 nt, Artificial Sequence
  derived and/or modified sequence opt2 from hemagglutinin__InfluenzaA__ABK40656
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagaacuucaacuggaccggcgucgcccaggacggcaaguccuacuccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggcaaggucaccgucuccaccaagcgcucccagcagaccgucauccccgacaucggcuaccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92934 - RNA, 1701 nt, Artificial Sequence
  derived and/or modified sequence opt2 from hemagglutinin__InfluenzaA__ABK40667
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagcuccgcaacggcaaguccuccaucaugcgcuccgacgcccccaucgacaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaccgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92935 - RNA, 1701 nt, Artificial Sequence; identical to SEQ ID NO: 92578
  derived and/or modified sequence opt2 from hemagglutinin__InfluenzaA__ABK40678

SEQ ID NO: 92936 - RNA, 1698 nt, Artificial Sequence
  derived and/or modified sequence opt2 from hemagglutinin__InfluenzaA__ABK40689
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92937 - RNA, 1701 nt, Artificial Sequence; identical to SEQ ID NO: 92162
  derived and/or modified sequence opt2 from hemagglutinin__InfluenzaA__ABK40700

SEQ ID NO: 92938 - RNA, 1701 nt, Artificial Sequence; identical to SEQ ID NO: 92162
  derived and/or modified sequence opt2 from hemagglutinin__InfluenzaA__ABK40711

SEQ ID NO: 92939 - RNA, 1701 nt, Artificial Sequence
  derived and/or modified sequence opt2 from hemagglutinin__InfluenzaA__ABK40722
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacaacgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92940 - RNA, 1701 nt, Artificial Sequence; identical to SEQ ID NO: 92162
  derived and/or modified sequence opt2 from hemagglutinin__InfluenzaA__ABK40733

SEQ ID NO: 92941 - RNA, 1701 nt, Artificial Sequence; identical to SEQ ID NO: 92817
  derived and/or modified sequence opt2 from hemagglutinin__InfluenzaA__ABK40744

SEQ ID NO: 92942 - RNA, 1701 nt, Artificial Sequence; identical to SEQ ID NO: 92427
  derived and/or modified sequence opt2 from hemagglutinin__InfluenzaA__ABK79948

SEQ ID NO: 92943 - RNA, 1698 nt, Artificial Sequence; identical to SEQ ID NO: 92716
  derived and/or modified sequence opt2 from hemagglutinin__InfluenzaA__ABK79959

SEQ ID NO: 92944 - RNA, 1701 nt, Artificial Sequence
  derived and/or modified sequence opt2 from hemagglutinin__InfluenzaA__ABK79970
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaagaaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgcccgccgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92945 - RNA, 1701 nt, Artificial Sequence
  derived and/or modified sequence opt2 from hemagglutinin__InfluenzaA__ABK79981
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92946 - RNA, 1701 nt, Artificial Sequence; identical to SEQ ID NO: 92162
  derived and/or modified sequence opt2 from hemagglutinin__InfluenzaA__ABK79992

SEQ ID NO: 92947 - RNA, 1701 nt, Artificial Sequence; identical to SEQ ID NO: 92433
  derived and/or modified sequence opt2 from hemagglutinin__InfluenzaA__ABK80025

SEQ ID NO: 92948 - RNA, 1701 nt, Artificial Sequence; identical to SEQ ID NO: 92433
  derived and/or modified sequence opt2 from hemagglutinin__InfluenzaA__ABK80036

SEQ ID NO: 92949 - RNA, 1701 nt, Artificial Sequence; identical to SEQ ID NO: 92433
  derived and/or modified sequence opt2 from hemagglutinin__InfluenzaA__ABK80047

SEQ ID NO: 92950 - RNA, 1701 nt, Artificial Sequence; identical to SEQ ID NO: 92278
  derived and/or modified sequence opt2 from hemagglutinin__InfluenzaA__ABK80058

SEQ ID NO: 92951 - RNA, 1701 nt, Artificial Sequence
  derived and/or modified sequence opt2 from hemagglutinin__InfluenzaA__ABK80069
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggauccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucgccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacgucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92952 - RNA, 1701 nt, Artificial Sequence
  derived and/or modified sequence opt2 from hemagglutinin__InfluenzaA__ABK80080
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugccucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92953 - RNA, 1701 nt, Artificial Sequence; identical to SEQ ID NO: 92162
  derived and/or modified sequence opt2 from hemagglutinin__InfluenzaA__ABK80091

SEQ ID NO: 92954 - RNA, 1701 nt, Artificial Sequence; identical to SEQ ID NO: 92162
  derived and/or modified sequence opt2 from hemagglutinin__InfluenzaA__ABK80102

SEQ ID NO: 92955 - RNA, 1701 nt, Artificial Sequence; identical to SEQ ID NO: 91563
  derived and/or modified sequence opt2 from hemagglutinin__InfluenzaA__ABK80113

SEQ ID NO: 92956 - RNA, 1701 nt, Artificial Sequence
  derived and/or modified sequence opt2 from hemagglutinin__InfluenzaA__ABK80124
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcaucguccuccucggcuucaucaugugggccugccagaagggcaacauccgcugcaacaucugcaucuga

SEQ ID NO: 92957 - RNA, 1701 nt, Artificial Sequence; identical to SEQ ID NO: 91563
  derived and/or modified sequence opt2 from hemagglutinin__InfluenzaA__ABK80135

SEQ ID NO: 92958 - RNA, 1701 nt, Artificial Sequence; identical to SEQ ID NO: 91563
  derived and/or modified sequence opt2 from hemagglutinin__InfluenzaA__ABK80146

SEQ ID NO: 92959 - RNA, 1701 nt, Artificial Sequence; identical to SEQ ID NO: 91563
  derived and/or modified sequence opt2 from hemagglutinin__InfluenzaA__ABK80157

SEQ ID NO: 92960 - RNA, 1701 nt, Artificial Sequence; identical to SEQ ID NO: 92074
  derived and/or modified sequence opt2 from hemagglutinin__InfluenzaA__ABK80168

SEQ ID NO: 92961 - RNA, 1701 nt, Artificial Sequence
  derived and/or modified sequence opt2 from hemagglutinin__InfluenzaA__ABK80179
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccguccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgccuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92962 - RNA, 1701 nt, Artificial Sequence; identical to SEQ ID NO: 92074
  derived and/or modified sequence opt2 from hemagglutinin__InfluenzaA__ABK80190

SEQ ID NO: 92963 - RNA, 1701 nt, Artificial Sequence; identical to SEQ ID NO: 92817
  derived and/or modified sequence opt2 from hemagglutinin__InfluenzaA__ABK80201

SEQ ID NO: 92964 - RNA, 1701 nt, Artificial Sequence
  derived and/or modified sequence opt2 from hemagglutinin__InfluenzaA__ABK80212
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 92965 - RNA, 1701 nt, Artificial Sequence; identical to SEQ ID NO: 92028
  derived and/or modified sequence opt2 from hemagglutinin__InfluenzaA__ABK80223

SEQ ID NO: 92966 - RNA, 1701 nt, Artificial Sequence
  derived and/or modified sequence opt2 from hemagglutinin__InfluenzaA__ABK80234
augcgcaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92967 - RNA, 1701 nt, Artificial Sequence
  derived and/or modified sequence opt2 from hemagglutinin__InfluenzaA__ABK80245
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaaccaguccuucuucucccgccucaacuggcucacccaccucaaguucaaguaccccgcccucaacgucaccaugcccaacaacgagaaguucgacaagcucuacaucuggggcguccaccaccccggcaccgacuccgaccagaucucccucuacgcccaggcccccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 92968 - RNA, 1701 nt, Artificial Sequence; identical to SEQ ID NO: 92967
  derived and/or modified sequence opt2 from hemagglutinin__InfluenzaA__ABK80256

SEQ ID NO: 92969 - RNA, 1701 nt, Artificial Sequence; identical to SEQ ID NO: 92124
  derived and/or modified sequence opt2 from hemagglutinin__InfluenzaA__ABK80267

SEQ ID NO: 92970 - RNA, 1701 nt, Artificial Sequence; identical to SEQ ID NO: 92145
  derived and/or modified sequence opt2 from hemagglutinin__InfluenzaA__ABK80278

SEQ ID NO: 92971 - RNA, 1701 nt, Artificial Sequence
  derived and/or modified sequence opt2 from hemagglutinin__InfluenzaA__ABK80289
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92972 - RNA, 1701 nt, Artificial Sequence; identical to SEQ ID NO: 91563
  derived and/or modified sequence opt2 from hemagglutinin__InfluenzaA__ABK80300

SEQ ID NO: 92973 - RNA, 1701 nt, Artificial Sequence; identical to SEQ ID NO: 91563
  derived and/or modified sequence opt2 from hemagglutinin__InfluenzaA__ABK80311

SEQ ID NO: 92974 - RNA, 1707 nt, Artificial Sequence
  derived and/or modified sequence opt2 from hemagglutinin__InfluenzaA__ABL07019
auggagaagaucguccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaccaagaagaacuccaccuaccccaccaucaagaaguccuacaacaacaccaaccaggaggaccuccucguccucuggggcauccaccaccccaacaacgaggccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacuccaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92975 - RNA, 1707 nt, Artificial Sequence
  derived and/or modified sequence opt2 from hemagglutinin__InfluenzaA__ABL07030
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucugggccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92976 - RNA, 1707 nt, Artificial Sequence
  derived and/or modified sequence opt2 from hemagglutinin__InfluenzaA__ABL10088
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccgaggucaacggccaguccggccgcauggaguucuucuggaccauccucaagcccaacgacgccaucaacuucgaguccaacggcaacuucgucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccaacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 92977 - RNA, 1707 nt, Artificial Sequence
  derived and/or modified sequence opt2 from hemagglutinin__InfluenzaA__ABL31766
auggagaagaucguccuccuccucgccaucgucuccuucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucugggccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92978 - RNA, 1707 nt, Artificial Sequence
  derived and/or modified sequence opt2 from hemagglutinin__InfluenzaA__ABL31780
auggagaagaucguccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaagggcuccugguccgaccacgaggccuccuccggcgucuccuccgccugccccuaccuccgcucccccuccuucuuccgcaacgucgucuggcucaucaagaagaacuccaccuaccccaccaucaagaaguccuacaacaacaccaaccaggaggaccuccucguccucuggggcauccaccaccccaacaacgaggccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 92979 - RNA, 1701 nt, Artificial Sequence
  derived and/or modified sequence opt2 from hemagglutinin__InfluenzaA__ABL67165
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccuccggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagaagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92980 - RNA, 1701 nt, Artificial Sequence
  derived and/or modified sequence opt2 from hemagglutinin__InfluenzaA__ABL67176
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92981 - RNA, 1701 nt, Artificial Sequence; identical to SEQ ID NO: 92944
  derived and/or modified sequence opt2 from hemagglutinin__InfluenzaA__ABL67187

SEQ ID NO: 92982 - RNA, 1701 nt, Artificial Sequence; identical to SEQ ID NO: 92899
  derived and/or modified sequence opt2 from hemagglutinin__InfluenzaA__ABL67209

SEQ ID NO: 92983 - RNA, 1701 nt, Artificial Sequence; identical to SEQ ID NO: 92433
  derived and/or modified sequence opt2 from hemagglutinin__InfluenzaA__ABL67253

SEQ ID NO: 92984 - RNA, 1701 nt, Artificial Sequence
  derived and/or modified sequence opt2 from hemagglutinin__InfluenzaA__ABL67264
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccuccuuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 92985 - RNA, 1701 nt, Artificial Sequence
  derived and/or modified sequence opt2 from hemagglutinin__InfluenzaA__ABL67275
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacgucggcaacggcugcuucaagaucuaccacaagugcgacaacgccugcaucggcuccauccgcaacggcaccuacgaccacgacgucuaccgcgacgaggcccucaacaaccgcuuccagaucaagggcgucaagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 92986 - RNA, 1701 nt, Artificial Sequence
  derived and/or modified sequence opt2 from hemagglutinin__InfluenzaA__ABL67286
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 92987 - RNA, 1701 nt, Artificial Sequence; identical to SEQ ID NO: 92517
  derived and/or modified sequence opt2 from hemagglutinin__InfluenzaA__ABL67297

SEQ ID NO: 92988 - RNA, 1701 nt, Artificial Sequence
  derived and/or modified sequence opt2 from hemagglutinin__InfluenzaA__ABL67308
augaagaccaucaucgcccucuccuacauccucugccucgucuucgcccagaagcuccccggcaacgacaacuccauggccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccuccugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggccucugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacguccgcugcaacaucugcaucuga

SEQ ID NO: 92989 - RNA, 1701 nt, Artificial Sequence; identical to SEQ ID NO: 92074
  derived and/or modified sequence opt2 from hemagglutinin__InfluenzaA__ABL67319

SEQ ID NO: 92990 - RNA, 1701 nt, Artificial Sequence; identical to SEQ ID NO: 92817
  derived and/or modified sequence opt2 from hemagglutinin__InfluenzaA__ABL67330

SEQ ID NO: 92991 - RNA, 1701 nt, Artificial Sequence; identical to SEQ ID NO: 92028
  derived and/or modified sequence opt2 from hemagglutinin__InfluenzaA__ABL67341

SEQ ID NO: 92992 - RNA, 1701 nt, Artificial Sequence; identical to SEQ ID NO: 92028
  derived and/or modified sequence opt2 from hemagglutinin__InfluenzaA__ABL67352

SEQ ID NO: 92993 - RNA, 1701 nt, Artificial Sequence; identical to SEQ ID NO: 91544
  derived and/or modified sequence opt2 from hemagglutinin__InfluenzaA__ABL67363

SEQ ID NO: 92994 - RNA, 1701 nt, Artificial Sequence
  derived and/or modified sequence opt2 from hemagglutinin__InfluenzaA__ABL67374
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaaccaguccuucuucucccgccucaacuggcucacccaccucaaguucaaguaccccgcccucaacgucaccaugcccaacaacgagaaguucgacaagcucuacaucuggggcguccaccaccccggcaccgacuccgaccagaucucccucuacgcccaggcccccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagaugcgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcgacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 92995 - RNA, 1701 nt, Artificial Sequence; identical to SEQ ID NO: 91794
  derived and/or modified sequence opt2 from hemagglutinin__InfluenzaA__ABL67385

SEQ ID NO: 92996 - RNA, 1701 nt, Artificial Sequence; identical to SEQ ID NO: 92124
  derived and/or modified sequence opt2 from hemagglutinin__InfluenzaA__ABL67396

SEQ ID NO: 92997 - RNA, 1701 nt, Artificial Sequence; identical to SEQ ID NO: 92142
  derived and/or modified sequence opt2 from hemagglutinin__InfluenzaA__ABL67407

SEQ ID NO: 92998 - RNA, 1701 nt, Artificial Sequence
  derived and/or modified sequence opt2 from hemagglutinin__InfluenzaA__ABL67418
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 92999 - RNA, 1707 nt, Artificial Sequence; identical to SEQ ID NO: 91540
  derived and/or modified sequence opt2 from hemagglutinin__InfluenzaA__ABL67781

SEQ ID NO: 93000 - RNA, 1707 nt, Artificial Sequence
  derived and/or modified sequence opt2 from hemagglutinin__InfluenzaA__ABL67794
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 93001 - RNA, 1707 nt, Artificial Sequence
  derived and/or modified sequence opt2 from hemagglutinin__InfluenzaA__ABL67816
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 93002 - RNA, 1707 nt, Artificial Sequence
  derived and/or modified sequence opt2 from hemagglutinin__InfluenzaA__ABL67827
auggagaagaucguccuccucuucgccaucgucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacgagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagaucgagcgccgccgcaagaagcgcggccucuucggcgccaucgccggcuuccucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 93003 - RNA, 1701 nt, Artificial Sequence
  derived and/or modified sequence opt2 from hemagglutinin__InfluenzaA__ABM22015
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 93004 - RNA, 1701 nt, Artificial Sequence
  derived and/or modified sequence opt2 from hemagglutinin__InfluenzaA__ABM22026
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucaagcgcuucgagaucuuccccaaggacuccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgcccgccgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93005 - RNA, 1701 nt, Artificial Sequence; identical to SEQ ID NO: 92145
  derived and/or modified sequence opt2 from hemagglutinin__InfluenzaA__ABM22037

SEQ ID NO: 93006 - RNA, 1701 nt, Artificial Sequence; identical to SEQ ID NO: 91563
  derived and/or modified sequence opt2 from hemagglutinin__InfluenzaA__ABM22059

SEQ ID NO: 93007 - RNA, 1701 nt, Artificial Sequence; identical to SEQ ID NO: 92817
  derived and/or modified sequence opt2 from hemagglutinin__InfluenzaA__ABM22070

SEQ ID NO: 93008 - RNA, 1701 nt, Artificial Sequence
  derived and/or modified sequence opt2 from hemagglutinin__InfluenzaA__ABM22081
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93009 - RNA, 1701 nt, Artificial Sequence
  derived and/or modified sequence opt2 from hemagglutinin__InfluenzaA__ABM22092
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacugggccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93010 - RNA, 1701 nt, Artificial Sequence; identical to SEQ ID NO: 92822
  derived and/or modified sequence opt2 from hemagglutinin__InfluenzaA__ABM22103

SEQ ID NO: 93011 - RNA, 1701 nt, Artificial Sequence; identical to SEQ ID NO: 92028
  derived and/or modified sequence opt2 from hemagglutinin__InfluenzaA__ABM22114

SEQ ID NO: 93012 - RNA, 1701 nt, Artificial Sequence; identical to SEQ ID NO: 92967
  derived and/or modified sequence opt2 from hemagglutinin__InfluenzaA__ABM22125

SEQ ID NO: 93013 - RNA, 1701 nt, Artificial Sequence
  derived and/or modified sequence opt2 from hemagglutinin__InfluenzaA__ABM22136
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaucggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93014 - RNA, 1701 nt, Artificial Sequence; identical to SEQ ID NO: 92145
  derived and/or modified sequence opt2 from hemagglutinin__InfluenzaA__ABM22147

SEQ ID NO: 93015 - RNA, 1701 nt, Artificial Sequence; identical to SEQ ID NO: 92433
  derived and/or modified sequence opt2 from hemagglutinin__InfluenzaA__ABM22158

SEQ ID NO: 93016 - RNA, 1701 nt, Artificial Sequence; identical to SEQ ID NO: 92433
  derived and/or modified sequence opt2 from hemagglutinin__InfluenzaA__ABM22169

SEQ ID NO: 93017 - RNA, 1701 nt, Artificial Sequence; identical to SEQ ID NO: 92433
  derived and/or modified sequence opt2 from hemagglutinin__InfluenzaA__ABM22180

SEQ ID NO: 93018 - RNA, 1701 nt, Artificial Sequence; identical to SEQ ID NO: 92433
  derived and/or modified sequence opt2 from hemagglutinin__InfluenzaA__ABM22191

SEQ ID NO: 93019 - RNA, 1701 nt, Artificial Sequence; identical to SEQ ID NO: 92433
  derived and/or modified sequence opt2 from hemagglutinin__InfluenzaA__ABM22202

SEQ ID NO: 93020 - RNA, 1701 nt, Artificial Sequence; identical to SEQ ID NO: 92433
  derived and/or modified sequence opt2 from hemagglutinin__InfluenzaA__ABM22213

SEQ ID NO: 93021 - RNA, 1701 nt, Artificial Sequence; identical to SEQ ID NO: 92433
  derived and/or modified sequence opt2 from hemagglutinin__InfluenzaA__ABM22224

SEQ ID NO: 93022 - RNA, 1701 nt, Artificial Sequence; identical to SEQ ID NO: 92433
  derived and/or modified sequence opt2 from hemagglutinin__InfluenzaA__ABM22235

SEQ ID NO: 93023 - RNA, 1701 nt, Artificial Sequence
  derived and/or modified sequence opt2 from hemagglutinin__InfluenzaA__ABM22268
augaaggucaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93024 - RNA, 1701 nt, Artificial Sequence
  derived and/or modified sequence opt2 from hemagglutinin__InfluenzaA__ABM22279
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgacugcgacgccaagugccagaccccccagggcgccaucaacuccucccuccccuuccagaacguccaccccgucaccaucggcggcugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93025 - RNA, 1701 nt, Artificial Sequence
  derived and/or modified sequence opt2 from hemagglutinin__InfluenzaA__ABM22290
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93026 - RNA, 1701 nt, Artificial Sequence; identical to SEQ ID NO: 91767
  derived and/or modified sequence opt2 from hemagglutinin__InfluenzaA__ABM22301

SEQ ID NO: 93027 - RNA, 1701 nt, Artificial Sequence; identical to SEQ ID NO: 91767
  derived and/or modified sequence opt2 from hemagglutinin__InfluenzaA__ABM22312

SEQ ID NO: 93028 - RNA, 1701 nt, Artificial Sequence; identical to SEQ ID NO: 91767
  derived and/or modified sequence opt2 from hemagglutinin__InfluenzaA__ABM22323

SEQ ID NO: 93029 - RNA, 1701 nt, Artificial Sequence; identical to SEQ ID NO: 91767
  derived and/or modified sequence opt2 from hemagglutinin__InfluenzaA__ABM22334

SEQ ID NO: 93030 - RNA, 1701 nt, Artificial Sequence; identical to SEQ ID NO: 91768
  derived and/or modified sequence opt2 from hemagglutinin__InfluenzaA__ABM22345

SEQ ID NO: 93031 - RNA, 1701 nt, Artificial Sequence; identical to SEQ ID NO: 91768
  derived and/or modified sequence opt2 from hemagglutinin__InfluenzaA__ABM22356

SEQ ID NO: 93032 - RNA, 1701 nt, Artificial Sequence; identical to SEQ ID NO: 91768
  derived and/or modified sequence opt2 from hemagglutinin__InfluenzaA__ABM22367

SEQ ID NO: 93033 - RNA, 1698 nt, Artificial Sequence; identical to SEQ ID NO: 92353
  derived and/or modified sequence opt2 from hemagglutinin__InfluenzaA__ABM66864

SEQ ID NO: 93034 - RNA, 1701 nt, Artificial Sequence; identical to SEQ ID NO: 92433
  derived and/or modified sequence opt2 from hemagglutinin__InfluenzaA__ABM66886

SEQ ID NO: 93035 - RNA, 1701 nt, Artificial Sequence; identical to SEQ ID NO: 92433
  derived and/or modified sequence opt2 from hemagglutinin__InfluenzaA__ABM66897

SEQ ID NO: 93036 - RNA, 1701 nt, Artificial Sequence; identical to SEQ ID NO: 92433
  derived and/or modified sequence opt2 from hemagglutinin__InfluenzaA__ABM66908

SEQ ID NO: 93037 - RNA, 1701 nt, Artificial Sequence; identical to SEQ ID NO: 91768
  derived and/or modified sequence opt2 from hemagglutinin__InfluenzaA__ABM66919

SEQ ID NO: 93038 - RNA, 1701 nt, Artificial Sequence; identical to SEQ ID NO: 91768
  derived and/or modified sequence opt2 from hemagglutinin__InfluenzaA__ABM66930

SEQ ID NO: 93039 - RNA, 1701 nt, Artificial Sequence; identical to SEQ ID NO: 91768
  derived and/or modified sequence opt2 from hemagglutinin__InfluenzaA__ABM66941

SEQ ID NO: 93040 - RNA, 1701 nt, Artificial Sequence; identical to SEQ ID NO: 91768
  derived and/or modified sequence opt2 from hemagglutinin__InfluenzaA__ABM66952

SEQ ID NO: 93041 - RNA, 1701 nt, Artificial Sequence; identical to SEQ ID NO: 91768
  derived and/or modified sequence opt2 from hemagglutinin__InfluenzaA__ABM66963

SEQ ID NO: 93042 - RNA, 1701 nt, Artificial Sequence; identical to SEQ ID NO: 91768
  derived and/or modified sequence opt2 from hemagglutinin__InfluenzaA__ABM66974

SEQ ID NO: 93043 - RNA, 1701 nt, Artificial Sequence; identical to SEQ ID NO: 91768
  derived and/or modified sequence opt2 from hemagglutinin__InfluenzaA__ABM66985

SEQ ID NO: 93044 - RNA, 1701 nt, Artificial Sequence; identical to SEQ ID NO: 91768
  derived and/or modified sequence opt2 from hemagglutinin__InfluenzaA__ABM66996

SEQ ID NO: 93045 - RNA, 1701 nt, Artificial Sequence; identical to SEQ ID NO: 91768
  derived and/or modified sequence opt2 from hemagglutinin__InfluenzaA__ABM67007

SEQ ID NO: 93046 - RNA, 1701 nt, Artificial Sequence; identical to SEQ ID NO: 91768
  derived and/or modified sequence opt2 from hemagglutinin__InfluenzaA__ABM67018

SEQ ID NO: 93047 - RNA, 1701 nt, Artificial Sequence
  derived and/or modified sequence opt2 from hemagglutinin__InfluenzaA__ABM67029
augaagaccaucaucgcccucuccuacaucaucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93048 - RNA, 1698 nt, Artificial Sequence; identical to SEQ ID NO: 91811
  derived and/or modified sequence opt2 from hemagglutinin__InfluenzaA__ABM67051

SEQ ID NO: 93049 - RNA, 1707 nt, Artificial Sequence
  derived and/or modified sequence opt2 from hemagglutinin__InfluenzaA__ABM90467
auggagaagaucguccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacaacgaggccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93050 - RNA, 1707 nt, Artificial Sequence
  derived and/or modified sequence opt2 from hemagglutinin__InfluenzaA__ABM90511
auggagaagaucguccuccuccucuccaucgucucccucgucaaguccgaccagaucugcaucggcuaccacgccaacaacuccaccgagcaggucgacaccaucaucgagaagaacgucaccgucacccacgcccaggacauccucgagaagacccacaacggcaagcucugcgaccucgacggcgucaagccccucauccucaaggacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacaacgaggaggagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacuccaacugcaacaccaagugccagacccccaugggcgccaucaacuccuccaugcccuuccacaacauccacccccucaccaucggcgagugccccaaguacgucaaguccucccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93051 - RNA, 1707 nt, Artificial Sequence
  derived and/or modified sequence opt2 from hemagglutinin__InfluenzaA__ABM90533
auggagaagaucguccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucaaggacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacaacgaggaggagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacuccaacugcaacaccaagugccagacccccaugggcgccaucaacuccuccaugcccuuccacaacauccacccccucaccaucggcgagugccccaaguacgucaaguccucccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 93052 - RNA, 1707 nt, Artificial Sequence; identical to SEQ ID NO: 93051
  derived and/or modified sequence opt2 from hemagglutinin__InfluenzaA__ABM90544

SEQ ID NO: 93053 - RNA, 1701 nt, Artificial Sequence
  derived and/or modified sequence opt2 from hemagglutinin__InfluenzaA__ABN50900
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93054 - RNA, 1701 nt, Artificial Sequence; identical to SEQ ID NO: 92433
  derived and/or modified sequence opt2 from hemagglutinin__InfluenzaA__ABN50917

SEQ ID NO: 93055 - RNA, 1701 nt, Artificial Sequence
  derived and/or modified sequence opt2 from hemagglutinin__InfluenzaA__ABN50928
augaaggccaagcuccucauccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93056 - RNA, 1701 nt, Artificial Sequence
  derived and/or modified sequence opt2 from hemagglutinin__InfluenzaA__ABN50940
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucuccgacuacgaggagcuccgcgagcagcucuccuccgucuccuccuucgagcgcuucgagaucuuccccaaggaguccuccuggcccaaccacaccgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccgaggacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93057 - RNA, 1701 nt, Artificial Sequence; identical to SEQ ID NO: 93023
  derived and/or modified sequence opt2 from hemagglutinin__InfluenzaA__ABN50951

SEQ ID NO: 93058 - RNA, 1701 nt, Artificial Sequence
  derived and/or modified sequence opt2 from hemagglutinin__InfluenzaA__ABN50962
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93059 - RNA, 1701 nt, Artificial Sequence; identical to SEQ ID NO: 92422
  derived and/or modified sequence opt2 from hemagglutinin__InfluenzaA__ABN50973

SEQ ID NO: 93060 - RNA, 1701 nt, Artificial Sequence; identical to SEQ ID NO: 91767
  derived and/or modified sequence opt2 from hemagglutinin__InfluenzaA__ABN50984

SEQ ID NO: 93061 - RNA, 1701 nt, Artificial Sequence; identical to SEQ ID NO: 91768
  derived and/or modified sequence opt2 from hemagglutinin__InfluenzaA__ABN50995

SEQ ID NO: 93062 - RNA, 1701 nt, Artificial Sequence
  derived and/or modified sequence opt2 from hemagglutinin__InfluenzaA__ABN51043
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93063 - RNA, 1701 nt, Artificial Sequence; identical to SEQ ID NO: 92908
  derived and/or modified sequence opt2 from hemagglutinin__InfluenzaA__ABN51054

SEQ ID NO: 93064 - RNA, 1701 nt, Artificial Sequence
  derived and/or modified sequence opt2 from hemagglutinin__InfluenzaA__ABN51066
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaagaaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcaccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgacugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcaucgaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucggcuucuggaugugcuccaacggcucccuccagugccgcaucugcaucuga

SEQ ID NO: 93065 - RNA, 1698 nt, Artificial Sequence; identical to SEQ ID NO: 91808
  derived and/or modified sequence opt2 from hemagglutinin__InfluenzaA__ABN51077

SEQ ID NO: 93066 - RNA, 1698 nt, Artificial Sequence; identical to SEQ ID NO: 91811
  derived and/or modified sequence opt2 from hemagglutinin__InfluenzaA__ABN51088

SEQ ID NO: 93067 - RNA, 1701 nt, Artificial Sequence
  derived and/or modified sequence opt2 from hemagglutinin__InfluenzaA__ABN51099
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaugaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93068 - RNA, 1701 nt, Artificial Sequence
  derived and/or modified sequence opt2 from hemagglutinin__InfluenzaA__ABN51110
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93069 - RNA, 1701 nt, Artificial Sequence
  derived and/or modified sequence opt2 from hemagglutinin__InfluenzaA__ABN51121
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcaccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgaccucgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93070 - RNA, 1701 nt, Artificial Sequence
  derived and/or modified sequence opt2 from hemagglutinin__InfluenzaA__ABN51132
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgccuccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93071 - RNA, 1698 nt, Artificial Sequence; identical to SEQ ID NO: 92312
  derived and/or modified sequence opt2 from hemagglutinin__InfluenzaA__ABN51143

SEQ ID NO: 93072 - RNA, 1701 nt, Artificial Sequence
  derived and/or modified sequence opt2 from hemagglutinin__InfluenzaA__ABN51154
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93073 - RNA, 1701 nt, Artificial Sequence
  derived and/or modified sequence opt2 from hemagglutinin__InfluenzaA__ABN59390
augaagaccaucaucgcccucuccuacaucaucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93074 - RNA, 1701 nt, Artificial Sequence
  derived and/or modified sequence opt2 from hemagglutinin__InfluenzaA__ABN59401
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacaagggcaaguccuccuucuaccgcaaccuccucuggcucaccgagaagaacggcuccuaccccaaccucaacaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93075 - RNA, 1698 nt, Artificial Sequence
  derived and/or modified sequence opt2 from hemagglutinin__InfluenzaA__ABN59412
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgaguuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 93076 - RNA, 1701 nt, Artificial Sequence
  derived and/or modified sequence opt2 from hemagglutinin__InfluenzaA__ABN59423
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgagaaccagaagaccaucuaccgcaaggagaacgccuacgucuccgucgucuccuccaacuacaaccgccgcuucacccccgagaucgccgagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93077 - RNA, 1701 nt, Artificial Sequence; identical to SEQ ID NO: 92278
  derived and/or modified sequence opt2 from hemagglutinin__InfluenzaA__ABO32656

SEQ ID NO: 93078 - RNA, 1701 nt, Artificial Sequence
  derived and/or modified sequence opt2 from hemagglutinin__InfluenzaA__ABO32667
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93079 - RNA, 1698 nt, Artificial Sequence
  derived and/or modified sequence opt2 from hemagglutinin__InfluenzaA__ABO32678
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccuccacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93080 - RNA, 1701 nt, Artificial Sequence
  derived and/or modified sequence opt2 from hemagglutinin__InfluenzaA__ABO32692
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93081 - RNA, 1701 nt, Artificial Sequence; identical to SEQ ID NO: 92945
  derived and/or modified sequence opt2 from hemagglutinin__InfluenzaA__ABO32751

SEQ ID NO: 93082 - RNA, 1701 nt, Artificial Sequence; identical to SEQ ID NO: 92945
  derived and/or modified sequence opt2 from hemagglutinin__InfluenzaA__ABO32762

SEQ ID NO: 93083 - RNA, 1701 nt, Artificial Sequence; identical to SEQ ID NO: 92967
  derived and/or modified sequence opt2 from hemagglutinin__InfluenzaA__ABO32775

SEQ ID NO: 93084 - RNA, 1701 nt, Artificial Sequence; identical to SEQ ID NO: 91755
  derived and/or modified sequence opt2 from hemagglutinin__InfluenzaA__ABO32790

SEQ ID NO: 93085 - RNA, 1701 nt, Artificial Sequence
  derived and/or modified sequence opt2 from hemagglutinin__InfluenzaA__ABO32803
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacacccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93086 - RNA, 1701 nt, Artificial Sequence; identical to SEQ ID NO: 92145
  derived and/or modified sequence opt2 from hemagglutinin__InfluenzaA__ABO32816

SEQ ID NO: 93087 - RNA, 1701 nt, Artificial Sequence; identical to SEQ ID NO: 91768
  derived and/or modified sequence opt2 from hemagglutinin__InfluenzaA__ABO32827

SEQ ID NO: 93088 - RNA, 1701 nt, Artificial Sequence
  derived and/or modified sequence opt2 from hemagglutinin__InfluenzaA__ABO32838
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93089 - RNA, 1701 nt, Artificial Sequence; identical to SEQ ID NO: 93088
  derived and/or modified sequence opt2 from hemagglutinin__InfluenzaA__ABO32849

SEQ ID NO: 93090 - RNA, 1701 nt, Artificial Sequence
  derived and/or modified sequence opt2 from hemagglutinin__InfluenzaA__ABO32860
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93091 - RNA, 1701 nt, Artificial Sequence; identical to SEQ ID NO: 93073
  derived and/or modified sequence opt2 from hemagglutinin__InfluenzaA__ABO32871

SEQ ID NO: 93092 - RNA, 1701 nt, Artificial Sequence
  derived and/or modified sequence opt2 from hemagglutinin__InfluenzaA__ABO32882
augaagaccaucaucgcccucuccuacaucaucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93093 - RNA, 1701 nt, Artificial Sequence
  derived and/or modified sequence opt2 from hemagglutinin__InfluenzaA__ABO32893
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93094 - RNA, 1701 nt, Artificial Sequence; identical to SEQ ID NO: 93093
  derived and/or modified sequence opt2 from hemagglutinin__InfluenzaA__ABO32904

SEQ ID NO: 93095 - RNA, 1701 nt, Artificial Sequence; identical to SEQ ID NO: 92908
  derived and/or modified sequence opt2 from hemagglutinin__InfluenzaA__ABO32915

SEQ ID NO: 93096 - RNA, 1701 nt, Artificial Sequence; identical to SEQ ID NO: 92908
  derived and/or modified sequence opt2 from hemagglutinin__InfluenzaA__ABO32926

SEQ ID NO: 93097 - RNA, 1701 nt, Artificial Sequence
  derived and/or modified sequence opt2 from hemagglutinin__InfluenzaA__ABO32937
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93098 - RNA, 1698 nt, Artificial Sequence
  derived and/or modified sequence opt2 from hemagglutinin__InfluenzaA__ABO32948
augcgcgccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93099 - RNA, 1698 nt, Artificial Sequence
  derived and/or modified sequence opt2 from hemagglutinin__InfluenzaA__ABO32959
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacacccucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93100 - RNA, 1698 nt, Artificial Sequence; identical to SEQ ID NO: 92716
  derived and/or modified sequence opt2 from hemagglutinin__InfluenzaA__ABO32970

SEQ ID NO: 93101 - RNA, 1701 nt, Artificial Sequence
  derived and/or modified sequence opt2 from hemagglutinin__InfluenzaA__ABO32981
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucaaggaccagaagaccaucuaccgcaaggagaacgccuacgucuccgucgucuccuccaacuacaaccgccgcuucacccccgagaucgccgagcgccccaagguccgcgaccaggccggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93102 - RNA, 1701 nt, Artificial Sequence
  derived and/or modified sequence opt2 from hemagglutinin__InfluenzaA__ABO32992
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacgacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucuccgagcgccccaagguccgcgaccagaagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93103 - RNA, 1701 nt, Artificial Sequence
  derived and/or modified sequence opt2 from hemagglutinin__InfluenzaA__ABO33006
augaaggccaagauccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucuccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93104 - RNA, 1701 nt, Artificial Sequence
  derived and/or modified sequence opt2 from hemagglutinin__InfluenzaA__ABO33025
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucaaggaccagcgcaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccaguccgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93105 - RNA, 1701 nt, Artificial Sequence
  derived and/or modified sequence opt2 from hemagglutinin__InfluenzaA__ABO33036
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacuccccccaccagauccucgacggcgagaacugcacccucaucgacgcccuccucggcgacccccacugcgacggcuuccagaacaaggagugggaccucuucgucgagcgccgcaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93106 - RNA, 1701 nt, Artificial Sequence; identical to SEQ ID NO: 91584
  derived and/or modified sequence opt2 from hemagglutinin__InfluenzaA__ABO33047

SEQ ID NO: 93107 - RNA, 1701 nt, Artificial Sequence; identical to SEQ ID NO: 92162
  derived and/or modified sequence opt2 from hemagglutinin__InfluenzaA__ABO33058

SEQ ID NO: 93108 - RNA, 1701 nt, Artificial Sequence
  derived and/or modified sequence opt2 from hemagglutinin__InfluenzaA__ABO33069
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaacuccuucuucucccgccucaacuggcucuacgaguccgaguccaaguaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagaagucccagcagaccaucauccccaacgucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccaagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93109 - RNA, 1701 nt, Artificial Sequence; identical to SEQ ID NO: 92433
  derived and/or modified sequence opt2 from hemagglutinin__InfluenzaA__ABO37988

SEQ ID NO: 93110 - RNA, 1701 nt, Artificial Sequence
  derived and/or modified sequence opt2 from hemagglutinin__InfluenzaA__ABO38010
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcgucggcuccggcaucaucaccuccaacgccuccaugggcgacugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93111 - RNA, 1698 nt, Artificial Sequence
  derived and/or modified sequence opt2 from hemagglutinin__InfluenzaA__ABO38021
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucauccccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucauccccgagauggccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93112 - RNA, 1698 nt, Artificial Sequence
  derived and/or modified sequence opt2 from hemagglutinin__InfluenzaA__ABO38032
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccgaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagacccccaagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 93113 - RNA, 1698 nt, Artificial Sequence; identical to SEQ ID NO: 92312
  derived and/or modified sequence opt2 from hemagglutinin__InfluenzaA__ABO38043

SEQ ID NO: 93114 - RNA, 1701 nt, Artificial Sequence
  derived and/or modified sequence opt2 from hemagglutinin__InfluenzaA__ABO38054
augaaggcccgccuccucguccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccgagcgcuccugguccuacaucgucgagacccccaacuccgagaacggcaccugcuaccccggcgacuucaucgacuacgaggagcuccgcgagcagcucuccuccgucuccuccuucgagcgcuucgagaucuucuccaaggaguccuccuggcccaagcacaacaccacccgcggcgucaccgccgccugcucccacgccggcaaguccuccuucuaccgcaaccuccucuggcucaccgagaaggacggcuccuaccccaaccucaacaacuccuacgucaacaagaagggcaaggagguccucguccucuggggcguccaccaccccuccaacaucaaggaccagcagacccucuaccagaaggagaacgccuacgucuccgucgucuccuccaacuacaaccgccgcuucacccccgagaucgccgagcgccccaagguccgcggccaggccggccgcaugaacuacuacuggacccuccucaagcccggcgacaccaucauguucgaggccaacggcaaccucaucgcccccugguacgccuucgcccucucccgcggcuucggcuccggcaucaucaccuccaacgccuccaugcacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93115 - RNA, 1701 nt, Artificial Sequence
  derived and/or modified sequence opt2 from hemagglutinin__InfluenzaA__ABO38065
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacaucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93116 - RNA, 1701 nt, Artificial Sequence; identical to SEQ ID NO: 91755
  derived and/or modified sequence opt2 from hemagglutinin__InfluenzaA__ABO38076

SEQ ID NO: 93117 - RNA, 1701 nt, Artificial Sequence
  derived and/or modified sequence opt2 from hemagglutinin__InfluenzaA__ABO38087
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacgucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93118 - RNA, 1689 nt, Artificial Sequence
  derived and/or modified sequence opt2 from hemagglutinin__InfluenzaA__ABO38098
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93119 - RNA, 1701 nt, Artificial Sequence
  derived and/or modified sequence opt2 from hemagglutinin__InfluenzaA__ABO38230
augaagaccaucaucgcccucuccuacaucuucugccaggucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucuucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccuccgucggcucccgccccuggguccgcggccucuccucccgcaucuccaucuacuggaccaucgucaagcccggcgacguccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucgacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93120 - RNA, 1701 nt, Artificial Sequence
  derived and/or modified sequence opt2 from hemagglutinin__InfluenzaA__ABO38241
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccgucaacuccuucuucucccgccucaacuggcucuacgaguccgaguccaaguaccccgcccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccggcugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaugaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93121 - RNA, 1701 nt, Artificial Sequence; identical to SEQ ID NO: 91794
  derived and/or modified sequence opt2 from hemagglutinin__InfluenzaA__ABO38252

SEQ ID NO: 93122 - RNA, 1689 nt, Artificial Sequence
  derived and/or modified sequence opt2 from hemagglutinin__InfluenzaA__ABO38296
auggucaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcacuuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgccaaggagcucggcaacggcugcuucgaguucuaccacaagugcgacgacgagugcaugaacuccgucaagaacggcaccuacuacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93123 - RNA, 1698 nt, Artificial Sequence; identical to SEQ ID NO: 92382
  derived and/or modified sequence opt2 from hemagglutinin__InfluenzaA__ABO38318

SEQ ID NO: 93124 - RNA, 1698 nt, Artificial Sequence; identical to SEQ ID NO: 92312
  derived and/or modified sequence opt2 from hemagglutinin__InfluenzaA__ABO38329

SEQ ID NO: 93125 - RNA, 1701 nt, Artificial Sequence
  derived and/or modified sequence opt2 from hemagglutinin__InfluenzaA__ABO38351
augaaggcccgccuccucguccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgcccgcuccugguccuacaucgucgagacccccaacuccgagaacggcaucugcuaccccggcgccuucaucgacuacgaggagcuccgcgagcagcucuccuccgucuccuccuucgagcgcuucgagaucuuccccaaggaguccuccuggcccaaccacaacaccaacaucggcgucaccgccgccugcucccacgccggcaaguccuccuucuaccgcaaccuccucuggcucaccaagaagggcggcuccuaccccaagcucaagaacuccuacgucaacaagaagggcaaggagguccucguccucuggggcauccaccaccccuccaacuccaaggaccagcagacccucuaccagaacgagaacgccuacgucuccgucgucuccuccaacuacaaccgccgcuucacccccgagaucgccgagcgccccgagguccgcgaccaggccggccgcaugaacuacuacuggacccuccucgagcccggcgacaccaucauguucgaggccaacggcaaccucgucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93126 - RNA, 1701 nt, Artificial Sequence
  derived and/or modified sequence opt2 from hemagglutinin__InfluenzaA__ABO38362
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucgucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgagaaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaucgacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93127 - RNA, 1698 nt, Artificial Sequence
  derived and/or modified sequence opt2 from hemagglutinin__InfluenzaA__ABO38373
augaaggcccgccuccucguccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccgagcgcuccugguccuacaucgucgagacccccaacuccgagaacggcaccugcuaccccggcgacuucaucgacuacgaggagcuccgcgagcagcucuccuccgucuccuccuucgagcgcuucgagaucuucuccaaggaguccuccuggcccaagcacaccaccggcggcgucaccgccgccugcucccacgccggcaaguccuccuucuaccgcaaccuccucuggcucaccgagaaggacggcuccuaccccaaccucaacaacuccuacgucaacaagaagggcaaggagguccucguccucuggggcguccaccaccccuccaacaucaaggaccagcagacccucuaccagaaggagaacgccuacgucuccgucgucuccuccaacuacaaccgccgcuucacccccgagaucgccgagcgccccaagguccgcggccaggccggccgcaucaacuacuacuggacccuccucaagcccggcgacaccaucauguucgaggccaacggcaaccucaucgcccccugguacgccuucgcccucucccgcggcuucggcuccggcaucaucaccuccaacgccuccaugcacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgccgccuccucccucguccuccucgucucccucggcgccaucuccuucuggaugugcuccaacggcucccuccagugccgcaucugcaucuga

SEQ ID NO: 93128 - RNA, 1701 nt, Artificial Sequence
  derived and/or modified sequence opt2 from hemagglutinin__InfluenzaA__ABO38384
augaaggcccgccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcauccccccccuccagcucggcaagugcaacaucgccggcuggcuccucggcaaccccgagugcgacucccuccuccccgcccgcuccugguccuacaucgucgagacccccaacuccgagaacggcgccugcuaccccggcgacuucaucaacuacgaggagcuccgcgagcagcucuccuccgucuccuccuucgagcgcuucgagaucuuccccaaggaguccuccuggcccaagcacaacaccaccaagggcgucaccgccgccugcucccacgccggcaaguccuccuucuaccgcaaccuccucuggcucaccaagaaggaggacuccuaccccaagcucaagaacuccuacgucaacaagaagggcaaggagguccucguccucuggggcguccaccaccccuccuccuccaaggagcagcagacccucuaccagaacgagaacgccuacgucuccgucgucuccuccaacuacaaccgccgcuucacccccgagaucgccgagcgccccaagguccgcgaccagaccggccgcaugaacuacuacuggacccuccucgagcccggcgacaccaucaucuucgaggccaacggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93129 - RNA, 1701 nt, Artificial Sequence
  derived and/or modified sequence opt2 from hemagglutinin__InfluenzaA__ABO38395
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggccgcuccuccuucuaccgcaaccuccucuggcucaccaagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93130 - RNA, 1701 nt, Artificial Sequence
  derived and/or modified sequence opt2 from hemagglutinin__InfluenzaA__ABO38406
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaacgucaccaagggcgucaccgccuccugcucccacaagggcaaguccuccuucuaccgcaaccuccucuggcucaccgagaagaagggcuccuaccccaaccucuccaaguccuacgucaacaacaaggagaaggagguccucguccucuggggcauccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccgcggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccaguccgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93131 - RNA, 1701 nt, Artificial Sequence
  derived and/or modified sequence opt2 from hemagglutinin__InfluenzaA__ABO38417
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccucccccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93132 - RNA, 1689 nt, Artificial Sequence
  derived and/or modified sequence opt2 from hemagglutinin__InfluenzaA__ABO38712
auggccaucaucuacuucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaagguccgcauccuccccaaggacggcuggacccagcacaccaccuccggcggcuccaaggccugcgccgucuccggcaaguccuccuucuuccgcaacauggucuggcucaccaagaagggccccaacuaccccgucgccaagcgcuccuacaacaacaccuccggcgagcagaugcucaucaucuggggcguccaccaccccaaggacgaggccgagcagcgcgcccucuaccagaaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacaacaagguccgcaugcagcuccgcgacaacgucaaggagcucggcaacggcugcuucgaguucuaccacaagugcgacgacgagugcauguccuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 93133 - RNA, 1689 nt, Artificial Sequence
  derived and/or modified sequence opt2 from hemagglutinin__InfluenzaA__ABO38723
auggccaucaucuacuucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaagguccgcauccuccccaaggacggcuggacccagcacaccaccuccggcggcuccaaggccugcgccgucuccggcaaguccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucggcaaccucaacaagaagauggaggacggcuuccucgacgucuggaccuacaacgccgagcuccucguccucauggagaacgagcgcacccucgacuuccacgacuccaacgucaagaaccucuacaacaagguccgcaugcagcuccgcgacaacgucaaggagcucggcaacggcugcuucgaguucuaccacaagugcgacgacgagugcauguccuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 93134 - RNA, 1698 nt, Artificial Sequence
  derived and/or modified sequence opt2 from hemagglutinin__InfluenzaA__ABO44046
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaagaugaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93135 - RNA, 1689 nt, Artificial Sequence
  derived and/or modified sequence opt2 from hemagglutinin__InfluenzaA__ABO44057
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacgagaccgacggcggcuccaaggccugcgccgucuccggcaaggccuccuucuuccgcaacauggucuggcucaccaagcgcggccccaacuaccaggucgccaagcgcuccuacaacaacaccuccggcgagcagaugcucaucaucuggggcguccaccaccccaaggacgaggccgagcagcgcgcccucuaccagaaggucggcaccuacgucuccgccuccaccuccacccucaacaagcgcuccacccccgagaucgccgcccgccccgaggucaacggccucgagucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacauccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcgucugcaucuga

SEQ ID NO: 93136 - RNA, 1701 nt, Artificial Sequence; identical to SEQ ID NO: 91768
  derived and/or modified sequence opt2 from hemagglutinin__InfluenzaA__ABO44079

SEQ ID NO: 93137 - RNA, 1689 nt, Artificial Sequence
  derived and/or modified sequence opt2 from hemagglutinin__InfluenzaA__ABO44090
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacaugaucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucgucaccuccacccucaacaagcgcuccacccccaagaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagcgcgccuucgacggcaucaccaacaaggucaacuccgucaucgagaagaugaacacccaguucgaggccgucggcaaggaguucuccaaccucgagcgccgccucgagaaccucaacaagaagauggaggacggccuccucgacgucuggaccuacaacgccgagcuccucguccucauggagaacgagcgcauccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93138 - RNA, 1689 nt, Artificial Sequence
  derived and/or modified sequence opt2 from hemagglutinin__InfluenzaA__ABO44101
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacaagaccgacggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccgaggucuccggccucggcucccgcauggaguucuccuggacccuccucgacgucugggacaccaucuccuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 93139 - RNA, 1701 nt, Artificial Sequence
  derived and/or modified sequence opt2 from hemagglutinin__InfluenzaA__ABO44123
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggcaaguccuccuucuaccgcaaccuccucuggcucaccaagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93140 - RNA, 1701 nt, Artificial Sequence
  derived and/or modified sequence opt2 from hemagglutinin__InfluenzaA__ABO44134
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93141 - RNA, 1701 nt, Artificial Sequence
  derived and/or modified sequence opt2 from hemagglutinin__InfluenzaA__ABO52071
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccuccaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93142 - RNA, 1701 nt, Artificial Sequence
  derived and/or modified sequence opt2 from hemagglutinin__InfluenzaA__ABO52225
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcucaaggagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucaagcgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93143 - RNA, 1689 nt, Artificial Sequence
  derived and/or modified sequence opt2 from hemagglutinin__InfluenzaA__ABO52236
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcacuuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgccaaggagcucggcaacggcugcuucgaguucuaccacaagugcgacgacgagugcaugaacuccgucaagaacggcaccuacuacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93144 - RNA, 1689 nt, Artificial Sequence
  derived and/or modified sequence opt2 from hemagglutinin__InfluenzaA__ABO52247
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacaagaccgacggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccgaggucuccggccucggcucccgcauggaguucuccuggacccuccucgacgucugggacaccaucuccuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggcccccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 93145 - RNA, 1701 nt, Artificial Sequence
  derived and/or modified sequence opt2 from hemagglutinin__InfluenzaA__ABO52258
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucacccgcggcgucaccgccuccugcucccacaagggcaagugcuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93146 - RNA, 1701 nt, Artificial Sequence
  derived and/or modified sequence opt2 from hemagglutinin__InfluenzaA__ABO52280
augaaggcccgccuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaaccgcuccugguccuacaucgccgagacccccaacuccgagaacggcaucugcuaccccggcgacuucgccgacuacgaggagcuccgcgagcagcucuccuccgucuccuccuucgagcgcuucgagaucuuccccaaggaguccuccuggcccaagcacaacaucacccgcggcgucaccgucgccugcucccacgccaagaaguccuccuucuacaagaaccuccucuggcucaccgaggccaacggccucuaccccucccucuccaaguccuacgucaacgaccgcgagaaggagguccucguccucuggggcguccaccaccccuccaacaucgaggaccagcgcacccucuaccgcaaggagaacgccuacgucuccgucgucuccuccaacuacaaccgccgcuucacccccgagaucgccgagcgccccaagguccgcggccagcccggccgcaugaacuacuacuggacccuccucgagcccggcgacaagaucaucuucgaggccaacggcaaccucaucgcccccugguacgccuucgcccucucccgcggccccggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcgacaacgagugcauggaguccgucaagaacggcaccuacgacuaccccaaguacuccgaggaguccaagcucaaccgcgccaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93147 - RNA, 1689 nt, Artificial Sequence
  derived and/or modified sequence opt2 from hemagglutinin__InfluenzaA__ABO52302
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcaacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcaucuaccagauccucgccaucuacgccaccgucgccggcucccucucccucgccaucaugauggccggcaucuccuucuggaugugcuccaacggcucccuccagugccgcaucugcaucuga

SEQ ID NO: 93148 - RNA, 1701 nt, Artificial Sequence
  derived and/or modified sequence opt2 from hemagglutinin__InfluenzaA__ABO52313
augaagaccaucaucgcccucuccuacaucuucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggccacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccgcaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93149 - RNA, 1701 nt, Artificial Sequence
  derived and/or modified sequence opt2 from hemagglutinin__InfluenzaA__ABO52335
augaagaccaucaucgcccucuccuacaucuucugccucguccucggccaggacuucccccgcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcaacaccuaccccguccucaacgucaccaugcccaacaacgacaacuucgacaagcucuacaucuggggcguccaccaccccuccaccgaccaggaccagaccucccucuacguccaggccuccggccgcgucaccgucuccaccaagcgcucccagcagaccgucauccccaacaucggcccccgccccuggguccgcggccucuccucccgcaucuccaucuacuggaccaucgucaagcccggcgacauccuccucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccaccgcugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93150 - RNA, 1701 nt, Artificial Sequence
  derived and/or modified sequence opt2 from hemagglutinin__InfluenzaA__ABO52346
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccgacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93151 - RNA, 1701 nt, Artificial Sequence
  derived and/or modified sequence opt2 from hemagglutinin__InfluenzaA__ABO52357
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuucgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93152 - RNA, 1701 nt, Artificial Sequence
  derived and/or modified sequence opt2 from hemagglutinin__InfluenzaA__ABO52368
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93153 - RNA, 1701 nt, Artificial Sequence
  derived and/or modified sequence opt2 from hemagglutinin__InfluenzaA__ABO52797
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaacgucaccaagggcgucaccgccuccugcucccacaagggcaaguccuccuucuaccgcaaccuccucuggcucaccgagaagaacggcuccuaccccucccucuccaaguccuacgucaacaacaaggagaaggagguccucguccucuggggcguccaccaccccuccaacaucaaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccaguccgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93154 - RNA, 1698 nt, Artificial Sequence; identical to SEQ ID NO: 92254
  derived and/or modified sequence opt2 from hemagglutinin__InfluenzaA__ABP49217

SEQ ID NO: 93155 - RNA, 1698 nt, Artificial Sequence
  derived and/or modified sequence opt2 from hemagglutinin__InfluenzaA__ABP49305
augaaggccaagcucaugguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93156 - RNA, 1701 nt, Artificial Sequence
  derived and/or modified sequence opt2 from hemagglutinin__InfluenzaA__ABP49316
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacaagggcaaguccuccuucuaccgcaaccuccucuggcucaccgagaagaacggcuccuaccccaaccucaagaaguccuacgucaacaacaaggagaaggagguccucguccucuggggcguccaccaccccuccaacaucgaggaccagaagacccucuaccgcaaggagaacgccuacgucuccgucgucuccuccaacuacaacaagcgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93157 - RNA, 1701 nt, Artificial Sequence
  derived and/or modified sequence opt2 from hemagglutinin__InfluenzaA__ABP49327
augaaggcccgccuccucguccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcuccgcaagugcaacaucgccggcuggauccucggcaaccccgagugcgagucccuccucuccgagcgcuccugguccuacaucgucgagacccccaacuccgagaacggcaccugcuaccccggcgacuucaccaacuacgaggagcuccgcgagcagcucuccuccgucuccuccuucgagcgcuucgagaucuuccccaaggaguccuccuggcccaagcacaacaccacccgcggcgucaccgccgccugcucccacgccggcaaguccuccuucuaccgcaaccuccucuggcucaccgagaaggacggcuccuaccccaaccucaacaacuccuacgucaacaagaagggcaaggagguccucguccucuggggcguccaccaccccuccaacaucaaggaccagcagacccucuaccagaaggagaacgccuacgucuccgucgucuccuccaacuacaaccgccgcuucacccccgagaucgccgagcgccccaagguccgcggccaggccggccgcaugaacuacuacuggacccuccucaagcccggcgacaccaucauguucgaggccaacggcaaccucaucgcccccugguacgccuucgcccucucccgcggcuucggcuccggcaucaucaccuccaacgccuccaugcacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucauccuccucgagaacgagcgcacccucgacuuccacgacuccaacgucaagaaccucuacgagaaggucaagucccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93158 - RNA, 1701 nt, Artificial Sequence
  derived and/or modified sequence opt2 from hemagglutinin__InfluenzaA__ABP49338
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93159 - RNA, 1701 nt, Artificial Sequence
  derived and/or modified sequence opt2 from hemagglutinin__InfluenzaA__ABP49349
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaacgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcauccaccaccccuccaacaucgaggaccagaagaccaucuaccgcaaggagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccucggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccaguccgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93160 - RNA, 1701 nt, Artificial Sequence
  derived and/or modified sequence opt2 from hemagglutinin__InfluenzaA__ABP49360
augaaggccaagcuccucauccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccaagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93161 - RNA, 1701 nt, Artificial Sequence; identical to SEQ ID NO: 92162
  derived and/or modified sequence opt2 from hemagglutinin__InfluenzaA__ABP49371

SEQ ID NO: 93162 - RNA, 1701 nt, Artificial Sequence; identical to SEQ ID NO: 92899
  derived and/or modified sequence opt2 from hemagglutinin__InfluenzaA__ABP49382

SEQ ID NO: 93163 - RNA, 1698 nt, Artificial Sequence
  derived and/or modified sequence opt2 from hemagglutinin__InfluenzaA__ABP49393
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcauccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93164 - RNA, 1701 nt, Artificial Sequence
  derived and/or modified sequence opt2 from hemagglutinin__InfluenzaA__ABP49404
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucggcgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93165 - RNA, 1701 nt, Artificial Sequence; identical to SEQ ID NO: 92162
  derived and/or modified sequence opt2 from hemagglutinin__InfluenzaA__ABP49415

SEQ ID NO: 93166 - RNA, 1701 nt, Artificial Sequence; identical to SEQ ID NO: 92162
  derived and/or modified sequence opt2 from hemagglutinin__InfluenzaA__ABP49426

SEQ ID NO: 93167 - RNA, 1689 nt, Artificial Sequence
  derived and/or modified sequence opt2 from hemagglutinin__InfluenzaA__ABP49437
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93168 - RNA, 1701 nt, Artificial Sequence
  derived and/or modified sequence opt2 from hemagglutinin__InfluenzaA__ABP49448
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucuccgagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacaccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93169 - RNA, 1689 nt, Artificial Sequence
  derived and/or modified sequence opt2 from hemagglutinin__InfluenzaA__ABP49459
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcacccccacccucaacaagcgcuccacccccgacaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93170 - RNA, 1689 nt, Artificial Sequence
  derived and/or modified sequence opt2 from hemagglutinin__InfluenzaA__ABP49470
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucuccaccuccacccucaacaagcgcuccacccccgacaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93171 - RNA, 1701 nt, Artificial Sequence
  derived and/or modified sequence opt2 from hemagglutinin__InfluenzaA__ABP49492
augaagaccaucaucgcccucuccuacaucuucugccucgucuucgcccagggccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccuccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93172 - RNA, 1701 nt, Artificial Sequence; identical to SEQ ID NO: 93068
  derived and/or modified sequence opt2 from hemagglutinin__InfluenzaA__ABP49503

SEQ ID NO: 93173 - RNA, 1701 nt, Artificial Sequence
  derived and/or modified sequence opt2 from hemagglutinin__InfluenzaA__ABP49514
augaagaccaucaucgcccucuccuacaucuucuaccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93174 - RNA, 1701 nt, Artificial Sequence
  derived and/or modified sequence opt2 from hemagglutinin__InfluenzaA__ABQ01311
augaaggcccgccuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccaagaaguccuccuucuacaagaaccuccucuggcucaccgaggccaacggcuccuaccccaaccucuccaaguccuacgucaacaacaaggagaaggagguccucguccucuggggcguccaccaccccuccaagaucgaggaccagcgcacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaagaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93175 - RNA, 1701 nt, Artificial Sequence
  derived and/or modified sequence opt2 from hemagglutinin__InfluenzaA__ABQ01322
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccaccucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccgccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93176 - RNA, 1701 nt, Artificial Sequence; identical to SEQ ID NO: 92162
  derived and/or modified sequence opt2 from hemagglutinin__InfluenzaA__ABQ01333

SEQ ID NO: 93177 - RNA, 1701 nt, Artificial Sequence
  derived and/or modified sequence opt2 from hemagglutinin__InfluenzaA__ABQ01344
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93178 - RNA, 1689 nt, Artificial Sequence
  derived and/or modified sequence opt2 from hemagglutinin__InfluenzaA__ABQ01355
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcgacggccucugcuaccccggcuccuucaacgacuacgaggagcucaagcaccuccucuccuccgucaagcacuucgagaagguccgcauccuccccaaggaccgcuggacccagcacaccaccaccggcggcucccgcgccugcgccgucuccggcaaccccuccuucuuccgcaacaugaucuggcucaccaagaagggcuccaacuaccccgucgccaagggcuccuacaacaacaccuccggcgagcagaugcucaucaucuggggcguccaccaccccaucgacgagaccgagcagcgcacccucuaccagaacgucgagaccuacgucuccgucgucaccuccacccucaacaagcgcuccacccccaagaucgccacccgccccaaggucaacggccucggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagcgcgccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93179 - RNA, 1701 nt, Artificial Sequence
  derived and/or modified sequence opt2 from hemagglutinin__InfluenzaA__ABQ01366
augaagaccaucaucgcccucuccuacaucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugaccaacaacgacaacuccgacaagcucuacaucuggggcguccaccaccccuccaccgacaaggagcagaccgaccucuacguccaggccuccggcaaggucaccgucuccaccaagcgcucccagcagaccaucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93180 - RNA, 1701 nt, Artificial Sequence; identical to SEQ ID NO: 92945
  derived and/or modified sequence opt2 from hemagglutinin__InfluenzaA__ABQ44383

SEQ ID NO: 93181 - RNA, 1701 nt, Artificial Sequence; identical to SEQ ID NO: 92145
  derived and/or modified sequence opt2 from hemagglutinin__InfluenzaA__ABQ44405

SEQ ID NO: 93182 - RNA, 1701 nt, Artificial Sequence
  derived and/or modified sequence opt2 from hemagglutinin__InfluenzaA__ABQ44416
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccgaggacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93183 - RNA, 1701 nt, Artificial Sequence; identical to SEQ ID NO: 91768
  derived and/or modified sequence opt2 from hemagglutinin__InfluenzaA__ABQ44427

SEQ ID NO: 93184 - RNA, 1689 nt, Artificial Sequence
  derived and/or modified sequence opt2 from hemagglutinin__InfluenzaA__ABQ44438
auggccaucaucuacuucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucaccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaagguccgcauccuccccaaggacggcuggacccagcacaccaccuccggcggcuccaaggccugcgccgucuccggcaaguccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcaguccgcccucuaccagaaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacaacaagguccgcaugcagcuccgcgacaacgucaaggagcucggcaacggcugcuucgaguucuaccacaagugcgacgacgagugcauguccuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 93185 - RNA, 1689 nt, Artificial Sequence
  derived and/or modified sequence opt2 from hemagglutinin__InfluenzaA__ABQ44460
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacaugaucuggcucaccaagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 93186 - RNA, 1701 nt, Artificial Sequence
  derived and/or modified sequence opt2 from hemagglutinin__InfluenzaA__ABQ44471
augaaggcccgccuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccaagaaguccuccuucuacaagaaccuccucuggcucaccgaggccaacggcuccuaccccaaccucuccaaguccuacgucaacaacaaggagaaggagguccucguccucuggggcguccaccaccccuccaacaucgaggaccagcgcacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaagaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacaacucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93187 - RNA, 1701 nt, Artificial Sequence
  derived and/or modified sequence opt2 from hemagglutinin__InfluenzaA__ABR15797
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93188 - RNA, 1701 nt, Artificial Sequence
  derived and/or modified sequence opt2 from hemagglutinin__InfluenzaA__ABR15808
augaaggcccgccuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccaagaaguccuccuucuacaagaaccuccucuggcucaccgaggccaacggcuccuaccccaaccucuccaaguccuacgucaacaacaaggagaaggagguccucguccucuggggcguccaccaccccuccaacaucgaggaccagcgcacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaagaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93189 - RNA, 1698 nt, Artificial Sequence; identical to SEQ ID NO: 92254
  derived and/or modified sequence opt2 from hemagglutinin__InfluenzaA__ABR15885

SEQ ID NO: 93190 - RNA, 1698 nt, Artificial Sequence
  derived and/or modified sequence opt2 from hemagglutinin__InfluenzaA__ABR15896
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgaggcccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93191 - RNA, 1698 nt, Artificial Sequence; identical to SEQ ID NO: 92253
  derived and/or modified sequence opt2 from hemagglutinin__InfluenzaA__ABR15907

SEQ ID NO: 93192 - RNA, 1698 nt, Artificial Sequence; identical to SEQ ID NO: 92254
  derived and/or modified sequence opt2 from hemagglutinin__InfluenzaA__ABR15918

SEQ ID NO: 93193 - RNA, 1701 nt, Artificial Sequence
  derived and/or modified sequence opt2 from hemagglutinin__InfluenzaA__ABR15929
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93194 - RNA, 1701 nt, Artificial Sequence
  derived and/or modified sequence opt2 from hemagglutinin__InfluenzaA__ABR15940
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccaucuccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcaucguccuccucggcuucaucaugugggccugccagaagggcaacauccgcugcaacaucugcaucuga

SEQ ID NO: 93195 - RNA, 1701 nt, Artificial Sequence; identical to SEQ ID NO: 92074
  derived and/or modified sequence opt2 from hemagglutinin__InfluenzaA__ABR15951

SEQ ID NO: 93196 - RNA, 1701 nt, Artificial Sequence
  derived and/or modified sequence opt2 from hemagglutinin__InfluenzaA__ABR15962
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcucccgcgccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93197 - RNA, 1701 nt, Artificial Sequence
  derived and/or modified sequence opt2 from hemagglutinin__InfluenzaA__ABR22241
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucgaguaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagaacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93198 - RNA, 1701 nt, Artificial Sequence; identical to SEQ ID NO: 92162
  derived and/or modified sequence opt2 from hemagglutinin__InfluenzaA__ABR28515

SEQ ID NO: 93199 - RNA, 1701 nt, Artificial Sequence
  derived and/or modified sequence opt2 from hemagglutinin__InfluenzaA__ABR28592
augaagaccaucaucgcccucuccuacgucuucugccucgucuucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcgacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuccgccugcaagcgcggccccgacaacggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccgaccucuacguccaggccuccggcaaggucaccgucuccaccaagcgcucccagcagaccgucauccccaacgucggcucccgccccuggguccgcggccucuccucccgcgucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93200 - RNA, 1698 nt, Artificial Sequence; identical to SEQ ID NO: 92254
  derived and/or modified sequence opt2 from hemagglutinin__InfluenzaA__ABR28768

SEQ ID NO: 93201 - RNA, 1698 nt, Artificial Sequence; identical to SEQ ID NO: 92254
  derived and/or modified sequence opt2 from hemagglutinin__InfluenzaA__ABR28779

SEQ ID NO: 93202 - RNA, 1701 nt, Artificial Sequence; identical to SEQ ID NO: 92945
  derived and/or modified sequence opt2 from hemagglutinin__InfluenzaA__ABR28790

SEQ ID NO: 93203 - RNA, 1698 nt, Artificial Sequence; identical to SEQ ID NO: 92254
  derived and/or modified sequence opt2 from hemagglutinin__InfluenzaA__ABR28801

SEQ ID NO: 93204 - RNA, 1701 nt, Artificial Sequence; identical to SEQ ID NO: 92162
  derived and/or modified sequence opt2 from hemagglutinin__InfluenzaA__ABR28812

SEQ ID NO: 93205 - RNA, 1701 nt, Artificial Sequence
  derived and/or modified sequence opt2 from hemagglutinin__InfluenzaA__ABR28823
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93206 - RNA, 1698 nt, Artificial Sequence; identical to SEQ ID NO: 92382
  derived and/or modified sequence opt2 from hemagglutinin__InfluenzaA__ABR28834

SEQ ID NO: 93207 - RNA, 1698 nt, Artificial Sequence; identical to SEQ ID NO: 92353
  derived and/or modified sequence opt2 from hemagglutinin__InfluenzaA__ABR28845

SEQ ID NO: 93208 - RNA, 1701 nt, Artificial Sequence
  derived and/or modified sequence opt2 from hemagglutinin__InfluenzaA__ABR28856
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaucaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93209 - RNA, 1701 nt, Artificial Sequence; identical to SEQ ID NO: 92119
  derived and/or modified sequence opt2 from hemagglutinin__InfluenzaA__ABR28867

SEQ ID NO: 93210 - RNA, 1701 nt, Artificial Sequence; identical to SEQ ID NO: 92074
  derived and/or modified sequence opt2 from hemagglutinin__InfluenzaA__ABR28878

SEQ ID NO: 93211 - RNA, 1698 nt, Artificial Sequence; identical to SEQ ID NO: 92716
  derived and/or modified sequence opt2 from hemagglutinin__InfluenzaA__ABR28900

SEQ ID NO: 93212 - RNA, 1701 nt, Artificial Sequence
  derived and/or modified sequence opt2 from hemagglutinin__InfluenzaA__ABR28922
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93213 - RNA, 1701 nt, Artificial Sequence; identical to SEQ ID NO: 93093
  derived and/or modified sequence opt2 from hemagglutinin__InfluenzaA__ABR88080

SEQ ID NO: 93214 - RNA, 1701 nt, Artificial Sequence
  derived and/or modified sequence opt2 from hemagglutinin__InfluenzaA__ABS00315
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucuccgccuccugcucccacaagggccgcuccuccuucuaccgcaaccuccucuggcucaccgagaagaacggcuccuaccccaaccucuccaaguccuacgucaacaacaaggagcgcgagguccucguccucuggggcguccaccaccccuccaacaucggcgagcagcgcgccaucuaccacaccgagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93215 - RNA, 1701 nt, Artificial Sequence
  derived and/or modified sequence opt2 from hemagglutinin__InfluenzaA__ABS00326
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucuccgccuccugcucccacaagggccgcuccuccuucuaccgcaaccuccucuggcucaccgagaagaacggcuccuaccccaaccucuccaaguccuacgucaacaacaaggagaaggagguccucguccucuggggcguccaccaccccuccaacaucggcgagcagcgcgccaucuaccacaccgagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93216 - RNA, 1701 nt, Artificial Sequence; identical to SEQ ID NO: 93152
  derived and/or modified sequence opt2 from hemagglutinin__InfluenzaA__ABS49899

SEQ ID NO: 93217 - RNA, 1701 nt, Artificial Sequence
  derived and/or modified sequence opt2 from hemagglutinin__InfluenzaA__ABS49910
augaagaccaucaucgcccucuccuacaucuucugccucgcccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagaugcgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 93218 - RNA, 1701 nt, Artificial Sequence; identical to SEQ ID NO: 92162
  derived and/or modified sequence opt2 from hemagglutinin__InfluenzaA__ABS49965

SEQ ID NO: 93219 - RNA, 1698 nt, Artificial Sequence
  derived and/or modified sequence opt2 from hemagglutinin__InfluenzaA__ABS49976
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacaacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93220 - RNA, 1698 nt, Artificial Sequence
  derived and/or modified sequence opt2 from hemagglutinin__InfluenzaA__ABS49987
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacaugaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93221 - RNA, 1701 nt, Artificial Sequence
  derived and/or modified sequence opt2 from hemagglutinin__InfluenzaA__ABS49998
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaucaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93222 - RNA, 1701 nt, Artificial Sequence
  derived and/or modified sequence opt2 from hemagglutinin__InfluenzaA__ABS50009
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccuccaagaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93223 - RNA, 1701 nt, Artificial Sequence; identical to SEQ ID NO: 92222
  derived and/or modified sequence opt2 from hemagglutinin__InfluenzaA__ABS50020

SEQ ID NO: 93224 - RNA, 1701 nt, Artificial Sequence
  derived and/or modified sequence opt2 from hemagglutinin__InfluenzaA__ABS50031
augaagaccaucaucgcccucuccuacaugcucugccucgucuucgcccagaagcuccccggcaacgacaacuccaccgccaugcucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcuccggccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93225 - RNA, 1701 nt, Artificial Sequence; identical to SEQ ID NO: 91563
  derived and/or modified sequence opt2 from hemagglutinin__InfluenzaA__ABS50042

SEQ ID NO: 93226 - RNA, 1701 nt, Artificial Sequence; identical to SEQ ID NO: 93205
  derived and/or modified sequence opt2 from hemagglutinin__InfluenzaA__ABS50053

SEQ ID NO: 93227 - RNA, 1701 nt, Artificial Sequence
  derived and/or modified sequence opt2 from hemagglutinin__InfluenzaA__ABS50064
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucucccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93228 - RNA, 1701 nt, Artificial Sequence
  derived and/or modified sequence opt2 from hemagglutinin__InfluenzaA__ABS50075
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93229 - RNA, 1698 nt, Artificial Sequence
  derived and/or modified sequence opt2 from hemagglutinin__InfluenzaA__ABS71665
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucucccgcgaguccugguccuacaucgucgagaagcccucccccgagaacggcaccugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucuccuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93230 - RNA, 1698 nt, Artificial Sequence
  derived and/or modified sequence opt2 from hemagglutinin__InfluenzaA__ABS71666
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucucccgcgaguccugguccuacaucgucgagaagcccucccccgagaacggcaccugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucuccuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93231 - RNA, 1698 nt, Artificial Sequence
  derived and/or modified sequence opt2 from hemagglutinin__InfluenzaA__ABS71667
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucucccgcgaguccugguccuacaucgucgagaagcccucccccgagaacggcaccugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacaucuccgucgucuccucccacuacucccgcaaguucacccccgagaucgccaagcgccccaagguccgcgaccaggagggccgcaucuccuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93232 - RNA, 1698 nt, Artificial Sequence
  derived and/or modified sequence opt2 from hemagglutinin__InfluenzaA__ABS71668
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucucccgcgaguccugguccuacaucgucgagaagcccucccccgagaacggcaccugcuaccccggccacuucgccgacuacgaggagcuccgcgagcagcucuccuccgucuccuccuucgagcgcuucgagaucuuccccaaggaguccuccuggcccaaccacaccgccuccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93233 - RNA, 1698 nt, Artificial Sequence
  derived and/or modified sequence opt2 from hemagglutinin__InfluenzaA__ABS71669
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93234 - RNA, 1698 nt, Artificial Sequence
  derived and/or modified sequence opt2 from hemagglutinin__InfluenzaA__ABS71671
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagauguuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93235 - RNA, 1698 nt, Artificial Sequence
  derived and/or modified sequence opt2 from hemagglutinin__InfluenzaA__ABS71672
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcgccucuccuccgucuccuccuucgagcgcuucgagauguuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgcccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93236 - RNA, 1698 nt, Artificial Sequence
  derived and/or modified sequence opt2 from hemagglutinin__InfluenzaA__ABS71673
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggccgcuccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacaccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucuccaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93237 - RNA, 1701 nt, Artificial Sequence; identical to SEQ ID NO: 92142
  derived and/or modified sequence opt2 from hemagglutinin__InfluenzaA__ABS71674

SEQ ID NO: 93238 - RNA, 1701 nt, Artificial Sequence
  derived and/or modified sequence opt2 from hemagglutinin__InfluenzaA__ABS71675
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93239 - RNA, 1701 nt, Artificial Sequence
  derived and/or modified sequence opt2 from hemagglutinin__InfluenzaA__ABS71676
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaucauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93240 - RNA, 1701 nt, Artificial Sequence
  derived and/or modified sequence opt2 from hemagglutinin__InfluenzaA__ABS71677
augaagaccaucaucgcccucuccuacauccucugccucgucuucgcccagaagcuccccggcaucgacaacuccaccgccacccucugccucggccaccacgccguccccaacggcaccaucgucaagaccaucaccgacgaccagaucgaggucaccaacgccaccgagcucguccagaacuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93241 - RNA, 1701 nt, Artificial Sequence
  derived and/or modified sequence opt2 from hemagglutinin__InfluenzaA__ABS71679
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93242 - RNA, 1701 nt, Artificial Sequence; identical to SEQ ID NO: 93241
  derived and/or modified sequence opt2 from hemagglutinin__InfluenzaA__ABS71680

SEQ ID NO: 93243 - RNA, 1701 nt, Artificial Sequence
  derived and/or modified sequence opt2 from hemagglutinin__InfluenzaA__ABS71682
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93244 - RNA, 1701 nt, Artificial Sequence
  derived and/or modified sequence opt2 from hemagglutinin__InfluenzaA__ABU80177
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccuccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93245 - RNA, 1698 nt, Artificial Sequence
  derived and/or modified sequence opt2 from hemagglutinin__InfluenzaA__ABU80298
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacaagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 93246 - RNA, 1701 nt, Artificial Sequence
  derived and/or modified sequence opt2 from hemagglutinin__InfluenzaA__ABU80320
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacuccuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93247 - RNA, 1701 nt, Artificial Sequence; identical to SEQ ID NO: 92551
  derived and/or modified sequence opt2 from hemagglutinin__InfluenzaA__ABU80331

SEQ ID NO: 93248 - RNA, 1701 nt, Artificial Sequence
  derived and/or modified sequence opt2 from hemagglutinin__InfluenzaA__ABU80400
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacgucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaaccgcaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 93249 - RNA, 1701 nt, Artificial Sequence
  derived and/or modified sequence opt2 from hemagglutinin__InfluenzaA__ABU92572
augaagaccaucaucgcccucuccuacauccucugccucgucuucacccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93250 - RNA, 1701 nt, Artificial Sequence
  derived and/or modified sequence opt2 from hemagglutinin__InfluenzaA__ABU92573
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93251 - RNA, 1701 nt, Artificial Sequence
  derived and/or modified sequence opt2 from hemagglutinin__InfluenzaA__ABU92575
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcuccaagcccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93252 - RNA, 1701 nt, Artificial Sequence; identical to SEQ ID NO: 91563
  derived and/or modified sequence opt2 from hemagglutinin__InfluenzaA__ABU92576

SEQ ID NO: 93253 - RNA, 1701 nt, Artificial Sequence; identical to SEQ ID NO: 91563
  derived and/or modified sequence opt2 from hemagglutinin__InfluenzaA__ABU92577

SEQ ID NO: 93254 - RNA, 1701 nt, Artificial Sequence; identical to SEQ ID NO: 91584
  derived and/or modified sequence opt2 from hemagglutinin__InfluenzaA__ABU92578

SEQ ID NO: 93255 - RNA, 1701 nt, Artificial Sequence; identical to SEQ ID NO: 91584
  derived and/or modified sequence opt2 from hemagglutinin__InfluenzaA__ABU92579

SEQ ID NO: 93256 - RNA, 1701 nt, Artificial Sequence; identical to SEQ ID NO: 91584
  derived and/or modified sequence opt2 from hemagglutinin__InfluenzaA__ABU92580

SEQ ID NO: 93257 - RNA, 1701 nt, Artificial Sequence; identical to SEQ ID NO: 93249
  derived and/or modified sequence opt2 from hemagglutinin__InfluenzaA__ABU92581

SEQ ID NO: 93258 - RNA, 1701 nt, Artificial Sequence
  derived and/or modified sequence opt2 from hemagglutinin__InfluenzaA__ABU92582
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcucaaguacaaguaccccgcccagaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93259 - RNA, 1701 nt, Artificial Sequence; identical to SEQ ID NO: 93258
  derived and/or modified sequence opt2 from hemagglutinin__InfluenzaA__ABU92583

SEQ ID NO: 93260 - RNA, 1701 nt, Artificial Sequence
  derived and/or modified sequence opt2 from hemagglutinin__InfluenzaA__ABU92584
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucgcccagaacggcaccuccuccgccugcaagcgccgcuccgacaaguccuucuucucccgccucaacuggcuccaccagcuccgcuacaaguaccccgcccucaacgucaccaugcccaacaacgagaaguucgacaagcucuacaucuggggcguccaccaccccggcaccgacuccgaccagaucucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaagacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucguccuccucggcuucaucaugugggccugccagaagggcaacauccgcugcaacaucugcaucuga

SEQ ID NO: 93261 - RNA, 1701 nt, Artificial Sequence
  derived and/or modified sequence opt2 from hemagglutinin__InfluenzaA__ABU92586
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 93262 - RNA, 1701 nt, Artificial Sequence
  derived and/or modified sequence opt2 from hemagglutinin__InfluenzaA__ABU92587
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccuacaacgaccagaucucccucuacgcccaggccuccggccgcaucaccgucuccaccaagcgcucccagcagaccgccauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93263 - RNA, 1701 nt, Artificial Sequence
  derived and/or modified sequence opt2 from hemagglutinin__InfluenzaA__ABU92588
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93264 - RNA, 1701 nt, Artificial Sequence; identical to SEQ ID NO: 92145
  derived and/or modified sequence opt2 from hemagglutinin__InfluenzaA__ABU92590

SEQ ID NO: 93265 - RNA, 1701 nt, Artificial Sequence
  derived and/or modified sequence opt2 from hemagglutinin__InfluenzaA__ABU92591
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93266 - RNA, 1701 nt, Artificial Sequence; identical to SEQ ID NO: 93265
  derived and/or modified sequence opt2 from hemagglutinin__InfluenzaA__ABU92592

SEQ ID NO: 93267 - RNA, 1701 nt, Artificial Sequence
  derived and/or modified sequence opt2 from hemagglutinin__InfluenzaA__ABU92593
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccggccagaagggcaacaagcgcugcaacaucugcaucuga

SEQ ID NO: 93268 - RNA, 1701 nt, Artificial Sequence
  derived and/or modified sequence opt2 from hemagglutinin__InfluenzaA__ABU92594
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgaguccugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccucuccggcuucaucaugugggccugccagaagggcaacauccgcugcaacaucugcaucuga

SEQ ID NO: 93269 - RNA, 1701 nt, Artificial Sequence
  derived and/or modified sequence opt2 from hemagglutinin__InfluenzaA__ABU92595
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93270 - RNA, 1701 nt, Artificial Sequence
  derived and/or modified sequence opt2 from hemagglutinin__InfluenzaA__ABU92596
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccgacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93271 - RNA, 1701 nt, Artificial Sequence; identical to SEQ ID NO: 92142
  derived and/or modified sequence opt2 from hemagglutinin__InfluenzaA__ABU92597

SEQ ID NO: 93272 - RNA, 1701 nt, Artificial Sequence; identical to SEQ ID NO: 91585
  derived and/or modified sequence opt2 from hemagglutinin__InfluenzaA__ABU92601

SEQ ID NO: 93273 - RNA, 1701 nt, Artificial Sequence; identical to SEQ ID NO: 91585
  derived and/or modified sequence opt2 from hemagglutinin__InfluenzaA__ABU92602

SEQ ID NO: 93274 - RNA, 1701 nt, Artificial Sequence
  derived and/or modified sequence opt2 from hemagglutinin__InfluenzaA__ABU92603
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93275 - RNA, 1701 nt, Artificial Sequence; identical to SEQ ID NO: 91585
  derived and/or modified sequence opt2 from hemagglutinin__InfluenzaA__ABU92604

SEQ ID NO: 93276 - RNA, 1701 nt, Artificial Sequence; identical to SEQ ID NO: 93274
  derived and/or modified sequence opt2 from hemagglutinin__InfluenzaA__ABU92605

SEQ ID NO: 93277 - RNA, 1701 nt, Artificial Sequence; identical to SEQ ID NO: 93274
  derived and/or modified sequence opt2 from hemagglutinin__InfluenzaA__ABU92606

SEQ ID NO: 93278 - RNA, 1701 nt, Artificial Sequence; identical to SEQ ID NO: 92124
  derived and/or modified sequence opt2 from hemagglutinin__InfluenzaA__ABU92608

SEQ ID NO: 93279 - RNA, 1701 nt, Artificial Sequence; identical to SEQ ID NO: 92124
  derived and/or modified sequence opt2 from hemagglutinin__InfluenzaA__ABU92609

SEQ ID NO: 93280 - RNA, 1701 nt, Artificial Sequence
  derived and/or modified sequence opt2 from hemagglutinin__InfluenzaA__ABU92610
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccacuccaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucgccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacauguccaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 93281 - RNA, 1701 nt, Artificial Sequence
  derived and/or modified sequence opt2 from hemagglutinin__InfluenzaA__ABU92611
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggcaagaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaucugggccugccucaagggcaacauccgcugcaacaucugcaucuga

SEQ ID NO: 93282 - RNA, 1701 nt, Artificial Sequence
  derived and/or modified sequence opt2 from hemagglutinin__InfluenzaA__ABU92612
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacaacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93283 - RNA, 1701 nt, Artificial Sequence; identical to SEQ ID NO: 92770
  derived and/or modified sequence opt2 from hemagglutinin__InfluenzaA__ABU92613

SEQ ID NO: 93284 - RNA, 1701 nt, Artificial Sequence; identical to SEQ ID NO: 93269
  derived and/or modified sequence opt2 from hemagglutinin__InfluenzaA__ABU92614

SEQ ID NO: 93285 - RNA, 1701 nt, Artificial Sequence
  derived and/or modified sequence opt2 from hemagglutinin__InfluenzaA__ABU92615
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacgucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93286 - RNA, 1701 nt, Artificial Sequence
  derived and/or modified sequence opt2 from hemagglutinin__InfluenzaA__ABU92617
augaagaccaucaucgcccucuccuacauccucugccucgucuucgcccagaagcuccccggcaacgacaacuccaccgccacccucugccucggccaccacuccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93287 - RNA, 1701 nt, Artificial Sequence; identical to SEQ ID NO: 92770
  derived and/or modified sequence opt2 from hemagglutinin__InfluenzaA__ABU92619

SEQ ID NO: 93288 - RNA, 1701 nt, Artificial Sequence; identical to SEQ ID NO: 93269
  derived and/or modified sequence opt2 from hemagglutinin__InfluenzaA__ABU92620

SEQ ID NO: 93289 - RNA, 1701 nt, Artificial Sequence
  derived and/or modified sequence opt2 from hemagglutinin__InfluenzaA__ABU92622
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacuccuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuccgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93290 - RNA, 1701 nt, Artificial Sequence; identical to SEQ ID NO: 91585
  derived and/or modified sequence opt2 from hemagglutinin__InfluenzaA__ABU92623

SEQ ID NO: 93291 - RNA, 1701 nt, Artificial Sequence
  derived and/or modified sequence opt2 from hemagglutinin__InfluenzaA__ABU92624
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggcccucggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93292 - RNA, 1701 nt, Artificial Sequence; identical to SEQ ID NO: 93274
  derived and/or modified sequence opt2 from hemagglutinin__InfluenzaA__ABU92625

SEQ ID NO: 93293 - RNA, 1701 nt, Artificial Sequence; identical to SEQ ID NO: 91585
  derived and/or modified sequence opt2 from hemagglutinin__InfluenzaA__ABU92626

SEQ ID NO: 93294 - RNA, 1701 nt, Artificial Sequence
  derived and/or modified sequence opt2 from hemagglutinin__InfluenzaA__ABU92627
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaaccgccccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93295 - RNA, 1701 nt, Artificial Sequence; identical to SEQ ID NO: 93274
  derived and/or modified sequence opt2 from hemagglutinin__InfluenzaA__ABU92628

SEQ ID NO: 93296 - RNA, 1701 nt, Artificial Sequence; identical to SEQ ID NO: 93274
  derived and/or modified sequence opt2 from hemagglutinin__InfluenzaA__ABU92631

SEQ ID NO: 93297 - RNA, 1701 nt, Artificial Sequence
  derived and/or modified sequence opt2 from hemagglutinin__InfluenzaA__ABU92632
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93298 - RNA, 1701 nt, Artificial Sequence
  derived and/or modified sequence opt2 from hemagglutinin__InfluenzaA__ABU92635
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcuccaucgucgccuccuccggcacccucgaguucaacaacgaguccuucaacuggaccggcgucacccagaacggcaccuccuccgccugcaagcgcaaguccaacaaguccuucuucucccgccucaacuggcucacccaccucaaguacaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93299 - RNA, 1701 nt, Artificial Sequence; identical to SEQ ID NO: 92142
  derived and/or modified sequence opt2 from hemagglutinin__InfluenzaA__ABU92636

SEQ ID NO: 93300 - RNA, 1701 nt, Artificial Sequence
  derived and/or modified sequence opt2 from hemagglutinin__InfluenzaA__ABU92637
augaagaccaucaucgcccucuccuacauccucugccucgucuucgcccagaagcuccccggcaacgacaacuccaccgccacccucugccucggccaccacgccguccccaacggcaccaccgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93301 - RNA, 1701 nt, Artificial Sequence
  derived and/or modified sequence opt2 from hemagglutinin__InfluenzaA__ABU92639
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaccaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93302 - RNA, 1701 nt, Artificial Sequence
  derived and/or modified sequence opt2 from hemagglutinin__InfluenzaA__ABU92640
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgccgcccuccucggcuucaucaugugggccugccagaagggcaacauccgcugcaacaucugcaucuga

SEQ ID NO: 93303 - RNA, 1701 nt, Artificial Sequence
  derived and/or modified sequence opt2 from hemagglutinin__InfluenzaA__ABU92641
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucucccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93304 - RNA, 1701 nt, Artificial Sequence
  derived and/or modified sequence opt2 from hemagglutinin__InfluenzaA__ABU92642
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaucgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93305 - RNA, 1701 nt, Artificial Sequence
  derived and/or modified sequence opt2 from hemagglutinin__InfluenzaA__ABU92643
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccgacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 93306 - RNA, 1701 nt, Artificial Sequence
  derived and/or modified sequence opt2 from hemagglutinin__InfluenzaA__ABU92645
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucgccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucguccuccucggcuucaucaugugggccugccagaagggcaacauccgcugcaacaucugcaucuga
